United States Patent 12,746,261 (PROBIOTIC BACILLUS COMPOSITIONS AND METHODS OF USE) - sequence listing, part 12

SEQ ID NO: 16 - DNA, 4089676 bp, Bacillus subtilis (residues 2,044,839-4,089,676 of 4,089,676)
gatcttagagttagagttgaatatacagggactgtttacttaggacaataataaatgaggggcgactagtcccttatcttatttttagttaaaaactatcttttattcaatctctatattcaacccagttgatctaactttgatttccctcatctctccaatctgtggcatatataaatgtttcttttcattagaaacaatttcacccttccaacaaccgttttgcacaaaggattttgtcccgattggtaaagtttgaagatctgcgttctctatgtattctccctcctctctataaatatctccttgttcagaaatcctccttttcgaaactttaatgtcgattttgtaaagtgaattttcatcctcaatcattaatttatatagccaatcagttatttttgattgctcttcactaccgttaaccatatcgaaaatcttcctgtacatgtcattcctcttcttttgaaaaatacttgtctcacctctttaatagttaaagtttcttgattttgcacttttccactcattaactatccacttcatatgtattcattaatttaatgataaaaccacgattttaatttaactttaatatgcaccatcttgagaaaatcccctttaattggtaaactcatacttaactttttatatacaagtgggtgttgccttgaataaaacaatcggaattgttggattaattatcagcatactagtgcaaactttttcggccgatgaatcgctatcgcataagattgctacggctttgttattggtatcaataatgatttataattttgaacatgctaaggattattctaaaaagtcacttgttattttaggagttacctttattcttttgatgctaggagtttatcaactgctctcatttaccagcgattactttgaaaagcttaatgtgaattttagatataccctcttatttgaaatagcattaattattgcattggtaacgattgcagtaaatgtaatgaagtacattgcgaatcggttaaggaaatcgactaatggtaaagagttatagctctttgccttttttatgctaaatgcttctttctatgcggtcttttatgtatgaaatcaaatgctaaatcaacttttctctggttccctttcctctgttactcgctgagtaacaacaataagttgaccgttttcttgacgatcaatactcttaactgaatatcctttagaaccgtaatattctccgataatctcatcaacgtggttactaagcagattcctctttatcacctgaaaaacctccacttattttatttttattctttattttttttatgatttcatcctataatccatctctccatttgccctctcctctatcacgacattaaccgacacacaatttccatatatatgggagtaatttcgctatttccccaacagataaatccatataatgtaattgtaagaaaaaattataagaatgggggatttacatgagttacaaaaaagtaataacaggtgttgcattatctgtaggtttacttgtttcagcatctccagcgttcgctgcaagtactagtcccgataaggaaatagtaaatgttgcaagtgatgattttaaagctcaagctatcaaatgggatctacctagtactactggtatttttgccaatacctttgaaaaagacggtatccgctggtatttaaaaggtattacaaaagtctcggaaggaaattggattggccactatgaaggtgtacgaatataagatcaaaatgggggggcatctagctccctttttaaattcatagtttgccagctctatctggttaaagtaatccttttaaacatagttcaaaagcacataccaattttgtatacatccccattaatacatctccctctctttaaaacagtctttttatcaagtgtagtgctactcataaacaacaaagacattatgatcatcaacaaacatttcgctgccatcagacaagtgtatccaaaaagcctcctctggttcatctctatagtcataaattgcgactacctttgtatttgattcttcactcactgactttctgacagttatttttatattatcttcaggcaaaataattgatttaatcattcacttcaatccaatcaaggtttgtattgcaccgttgtgcttcaagtaacatctagtcacaagattgaaccttattcgttaatacacttggtcccaacttttctgttctagcattagaaagacgcacttgaactttaacattcttcatttcggctgtaattgagtcaatccttccagcccaactaggactgtcttcaggtgtaggataaagtttaaatcgccaactaatctcacctggtttagaagcaaaaccttcgtaggtatcgtaatttccatatgaagatggttccggaagatgaacagcaagaatacttatattggttcttggagcactaggcggatttaattgcaccttataaattaatgccacgccttttacatttctaaggctctgatcaacaggttccattattacactacaaggcattgtacttgcttttacttgaattggataggcaacagcagcagccaataaggatataaccaaaataaatcgtctcatggagagttcctcatatttttttggttaatttcccttatttctggatcgattattcatatgtatttgatctggacttcaattttattttgatttaatttcaacagttaaactgtctggatagttttttaaatcaagtgcgtttacatgacagtgacctacattttcttctttatcaacgtaattatagaagaacttttccccattattgatgatgacttcgccatgatgtatgtactccatctctgatcccttgtaccaagttaccttaacctttgtgctaggtttgattttatttaaatcaaatactgttatttcttttagcaagttcatttttttaacctcctcttctcttttacttttaatctaattccctcatgtcctcctgctgctcaatataacttttaaagtcctcccattccctatcaatttctttaatattcctagcaatataggtttctgtaatgtctggatcaaccaacttttgaagagaaagttggtacataaattcaatctttgatactgtttctagaaatgactgggcataactttttgctctatttaagcgatattgactcattccatgttttgattcctttattattctcactcccttttaatcacattaaaatgcagcttttatttagacttcatcagcttgtctaatagtgtctaacaactctttcttcttgaaatatgtctttttccaaacgatccacttccttttgcaattcagtagcagcagcattcttcagaatccattctcctactccacagacttccttttgttctttctcaaacgtttttatatgttgatcttcgaacctaacccttactcttgttccgttttcaaattcattattaaaagcagctgctttcttttattcttcaagctgcttaatccttttgttgttgttaaatgagttacttacaatatttcctgattcacgagtagtacttataattaataatggaaagcttatatcacctttaggtcttaaaggtacgttgaggttttgactcggttagtaacttttggagaggagttgctgaccatctttttcattaaattaattgcatacagaaatttaataatggaggaatttagattgctgcttaatgacagagattgctgcttaatgacagagaacgttttttgcttgagtatcttcttgtttctaatcggatcaaatcgtcgtttgataccttctaatatactcactatctctgtcttttcttcttcaagaaaagctccaagaaaagatccttttgaaaattctggtttaaaggatctaggactatctatgagctcaccatttgatacaaatatactcagtcttatgtccttcgatgtcttacggaagaactgtttgataaggctagagctctacatagaaatatcggtgagcgtgtttactttttaaagtctgacgtctgcattttgtatcatgagtggatatcgtgacatccatttgctgcgacttcttttcaaatgaaatgaccaccgcaaaagaacagattagcaagcggttgtactataataaacacctaatggatacttattttaaaggaaagattgaagagcataatgtcattacggattgcgacattgataaggtgttacataagatgtacttaagatttggattcagagagtataaacgaaacaattatgagcatgtctttgatcttttgggtatataataagtcttatactgctttttagtaacaaatattggatttcgagtttttttcggctgactcacaaattcgaatgaaaatcaagggcaaaattaaaaaaatgaataattaagagggtgtataaggcttaatattattaatcgttaccgtaacagcaaaaaatgaatcgaagacttatttttatgcaaattggcgaatatcaataacgtcttagtcataatacttaataacctaaagcaaaggctgaatttatgaaagggttattttagatgggtacatataatagaagaaactcgtcacagataaatcatttagatggacggtgaggaacttaaataagctgcagaaggaagatatgaagttgttcaatatctccttaaaacaaccactttcccctactcccgcttatgttttacgatcgtttaccccctattcactaattaaagtatcaaaaatccttatgtttactgtcttttttagctcattataaatttttacgataagcatgttattcgtgtacgatatacgacttgactgtaattggtgacgatttaacagagatatttaatgcacttctaacttttttaactgcaatgggaatcattgttgacccaacaactcaaggtatttctgatagtgaacaagcaatggattatgataaaccccctccccttctcttaattgaggagggtatttttttcgtaatgaaaaaattgcagaaaactttacatccttttacaattttttcaatgactatgttatgattgttttcgagagatttttgaaattttcagaaagaggggtttggatgagtaagatcgcttcagaagttgtcgctactacactgaatgactggtacattgctataaaaaagcaaaaggttgatgagtcaataaaatattattcagagataaagaaactttttgatgaaatggaagaagatcaagaagttcttgcgtattatagtttattagaagaaagacataaaatgttgctacattcctcacgaggagaacctttgcaaaagcacacctattttactgaagacaatcaaaacttcattaaaaaaacaaatgataaattagaatacaacttttatctatttgaagcaatgtatgaggcatacaacaaaaactatgatcgagcaattaacttatatggattagctgagaaaaagcttgcagaaattccagacgaaattgaagcagctgaattttactctaaagtctcttacttatacactcttgttaaacaaagcattgtggcacaacattatataaaaaatgcaatttcgatatataagcgacaccctgattacaaatgcaaacttgctacatcaacaatgattgcagctgcgaactatgctgatatgaaacgatttgaggaagcagaaaaatattacttagaagcaattgatattgcaaaagaaacaaaagatgaatttttgaaagctcaattatttcacaatcttagcatcgtttattctgattggaataaacctgataaatgcatcgaatctcttgaaaaagcaataggaaatgaatcttggttacattcaatttattatataaattctttattcatgataattaaagaactctttaaaattgacgaaaaaatgaaagccattaatttttacaataaagcacaggaaagactcatattaatggagaataaagtatacgaagccaaaattagcatcttatacaacctttattgtggtgaattaaaaaataatttcaataattgtattagtaatattgagtttttaaagcaacaaaatgaacttgaaagtgtagatgaattgtcctacatagctgcaaaaaggtttgaatcaataggtgcttttgaagaagcaacgagctttttcaatgcgaaaatttgggctgaacagaaaatgaatcaggtggagggaatcttatgaaaaaacttgtgctttgcgtatctattttagctgtgattttaagtggagtagctttaacgcaattgagtacagattcaccatctaacatccaggtagctgaaaggcctgtcggaggttaaaaaaggttgattaattaatttagccctactcatacacttgagtgggcttttattttatgatttatgtccaccagtcaacccagctctgtgaagcgctgtacctgcaaacgtaactgagatatttctcactgttttgcccgagtaaaacttattaaagaacatcaagcaacacttataaatatccatcgtgatatttgtgggaaaatcaattgttttggatcgatgaaatccaccaccaagctcatctttactgtaaccaattccaaggctgatcgttcgaccaactttattatgtgtacatgcccttcttgcgacttcctcacaaatttccaaaagaacagccttaatctcttctctccttgtataatccctcagtaaaatctgactcttatcaaaactaatctgaccttgcatcaactgagcacctatttctgataaatcaattccatgcgcatgatagtacaactggtttcccattattccgaacttcttttcaagcagctctaaaggaaatttagctaactggcctacagttgatatacccatccgattcaggtttctttccatcctccctcctattccccatattttagacagtgaaccttccagagtttatttggcacatcttcatatctccaacgtgcaataccactctttgttttcttactctccaggtcaagcgcaagcttactaagcaacatattgtcaccaattccaactgtgcacatcaaaccaaattctctccacatgctgctttggattgctttggccatttcttcaggattctcttttcctgcatctaaaaaagattaatcaattgaatacgtgtggacacatttttcaggaacaaatctgtaaaacagctttgtaatctcagttgaaactctgatgaaaagcttcatttgtggatttacaatgtatattcttggatcttcaggtatctcaaatagtctcgatcctgttttgattccaaaatcttttttaagtgcaggagatgcggctaatactacacttacctgtctctcgatatttcttacaacagccgatacagaagtataaaacacaaagtatattcttacgtagaaattgtgagtaatcaatcattgtatgtaactccttgttatatatactgtgttgttatgttgatctttaacgtgaagcttgtgttgttcaaaattaatgtaatgaactcttccggcggcattttcaaacaaatccatagttgtaaagtttgaatttcaaaatttaagtgcttcagaaacgagaacgtccatcatctcaatttttgatccatcaatcaaatcttgtttaagctgtattaaatgttctagcatcattgatgtccattgattgttcctcgatccctaaacatatcgactcactccttgattgatctaatatcaacagaactaatgttccttattcaatgcagataagaacaaacgttcgatgtaaatgttggtaataaaatataaaggtcaataatgatatccgtagtattaataaaggagagattcttttcgacgagggagagtgtgatggtgaatgaagaagaggttaattggatttttggtcttagttcctgctttgattatgtcgggtataactttaatcgaatcaaacaaaaagacccctgtagaagttttagaaagtgcttgggatgaatttgggttatttagttttgaaattggaataacagatccggcaattacaataggcatggatcaaaccaaaagtgaagcaaaacttcgtgaatatttaaaagataatctgtctagagaagccaaggaaaaatataagatttatatattcaaggacgatattgttaagcttgagaaagagcatcaagaatatttgcaagaaaataatctcaataagtaaaacgcccagcacttattgagctgggcactgtttcatatttaaattgaatttttataagcattaatagcttcgtttcgcaacaacatattatttttgttaaccatgcctatgttgtaagcttttttgataatatctaatacctgtgaatctaatgcagagagattacctcccggattaaatcttgatttccaataatctaaagacttatttaggtcaagtgagctttttttgttctcgggtttaactacttcatttttctcaagtttttcacagaattcactaaaactaattgatgaaagagtaggattatcccctccatacccttctgtagccaaactgcaaaatgctaagaatttcggatcataaataagatcgcttgagtttacattcatcacagataatcacaatcctctcagagctttttataattgtattaccttttccatttttacacatgttaaatatcgacaatccctcaaatcatttaataaggttatgtcaaattttaatgttgataaatacgcaaaaataaaaggaaaccatagttccaagtaccttttaggctttctaaaccaatttttacagcgtttagtccctttttgacaacagttgtgtttgaacctttttctgtcgtgcttttataagcatttgaaagtttactaaaagttgactctaaagatttaatggacaaatcttgaatttcttggctaacaatcttcatttacaattctcacttttcgttttaaaaacaacacctactcaatagttgaatttaggactacgccttgaattttgcgattcgcaaactatcatatcagctacagctttaaatgtttttcttagcttcaccatttgtgaccttagtcccttgtactctttggctcttttatccgcttcagagagcaatgaatcagcttcaaataccttcatttcattctcctttcaagcctactctatgtaaatttcaccacaattatttgcttgaataacagaaaaagacagccagaactgactgtcttatacatcgtgcgatcgtgttctataataattttctgcggtatagtagcaccattcccaaaaagttgccccattggattctatataccgatctagaaatatctcaaaatttaaatttaatggtgtatattcccctatttctaatataaaaagatagttgggatcccctttatccaatttatctttgtcgatcatcaaatggcacccttctaataagtgaccaattgggataccattgatgccttcaaacaaatcctcatattttaattcttcttcaatctcttcaaggctaaataaataaagtcctccacctatattctccccatcagaaagaatttcaaaaattttcgcaccgttatgtagtgtcatgaacttctgataatcctctggaagggtaatctgatgtttagcttcaaaactttgaatgtcgttaagggttgctttgtcctgtgaaaatgtaacaaggaactccatgatatctccttcagaacaaaacaattgaatggctcctttttcgtctaaaagacttttcaagccatttacagtcttatgaacaaagttagtcacatacatcacccctttatttccttttaacaataacctttcaaattccaaaagatgtgaacagatcgtgataggtgctcttttcagtgaatataatgcaataaattctaaaaagaggtgcctctaaaaattgaattctctaatgaatgatgacatggtaaagatcattagaaatggccttagcgcatcccagcatccaaagcatattcttgttgtaggagctggattgtccgggcttgtatcagcatcattgctgaaaaatgccggtcacagagtaacgattctcgaagcgagcggcagagcgggcggccgtgtctgcactttgagagctccctttagtgatgatttgtattttaacgctggcccgatgcgcataccgaataaccattcgttaaccttagaatatatcaaaaaattcaaattgccaacaaatgtatttctcaacagaaccccgatggacatcatttatgcaaatggaatcaaaacacgtctccaagtttttgaacgagctcctggaatattgagatacccagttgcaccaaatgaacaagggaaaacatctgaagagctgatgctttctttactgcagcctattctaaattttatcaatcaaaatccagcgagaaattggcggattgtcgaagaacaatacaaaaatcattcgttaagctcttttttaaacacgtatttttcatatggcgcgatcgatatgatcggtgtacttttggatatggaagcgtatatggggatgtcccttgttgaagtattgcgggaatctatctttttttcatcgcccgctcacttctatgagataactggcggcatggatctgctgcctcacgcgttgcttcctcaattaaaaacaaacattctataccatcaaaaaatgatgaaaatttctcaggggaaaaatcgtgttacgatccattgtcagcatcaacaaacggcagaattcacatcattcacagctgatctcgctattgtaaccattcctttttcaacattgcgatttgtaaaagtcgaaccataccattcattctcttactataaacgaagggcaatccgtgagctaaactatatcagtgcaacaaaaatcggcatagagtttaaaagccgattttgggaaaaagccgggcagcgcggcggcaaatctattactgatctaccgattcgtttttcgtattatccaagcagaaatattggagcaaatggacatgccgtcattctggcaagttatacttgggctgatgaggcactgatatgggacagtctttcagaaggagagcgaatccagtatactttactgaatttatctgaaatctatggtgatattgtgtggtctgaatttgtgtctggcacttcttttagctggagccagtacccgtattctgcggggggatttacagctttcgaaccaggacaagaattagagctgtatccctatattcctgtccctgagggcagagttcatttcgccggagaacacgcctcactcactcatgcgtggatgcaaggcgcgattgaatctggaatacgtgttgcttatgaggtcaatcgcttaccttagatcatgctcacatcttgttaaaactggttgatataaaaagaagtgaagaatttatactcctttgtttaaaagattaattcaaatatgggatgtctcaacattcagttctttattatttttatacacgttttgaatgcggacctcccttttcttccataatcattaataaatacccaaccatagaaaacgttttaattaaccatcgggcgaactttctttcactgtataacgattcttaatgttgcttttttatcctttacttgtcctctctttttttcattgacttacatttcttgaaaaccagtataaatcctaaaggaattttgtaacaaatacagaattggaaagataagcgccaaaagaaatgctaactccttatctcaaagacaaaactgcgcttatattaaaagaaagaggtgtctttagaatggttcattttaaaaactgccctgatccttctctaaacgccaattctcagtctcaccccgaattttcatccgaattagaacatattaagacaagaatgcaaaactttattaagcactcggttacagcccaaaatatcgaagttactgacgcaagggtgacggccgaaggagaggtcacctctcttttaaaagaacgtctcgacaaggaatattataggcttttatctaaaatcacccgggaagtaaatgtggctgacttcggcgctgttccagatggaagagacaatactgaagcttttcgaaaagcaatcgggaatggccgagtcaaagtacatgttccagcgggagaatacctcgttcaagggattaaacttccatcttggacaacaattgttggacaaggtaaagggatcacagtgattaaattgcatgaagacactccagcgcatgaatgggtgattacaaatgatgattatcaaaatggaaatcgcaatatttttgtccaaggaatgtcattagactggaatccaagtagacaatgcggtgtgagaaatccagggggacagttctccagttgtttaacttttgctaaggttgaatatgggtggatcaaagatgtggaagcgattaacgcaggtcttcatggtattgatattacatcgccaacgtatgaccatttgcctgataccgattggacaaaagacggatcaagatatatttggatcgataactgtgtgacatatggttcaggagacgacggcattaccacccattatagcgaatacatctttatttcaaactgccattcaggaaatccgcggggaacagaatttgctgaaggtgtttcaaactccaacggaatagaaattgacgacggctctaggcatgtgtggcttttgaataactttacaagcggcaacatccgcggagttgaagtaaaagcccatgaactgtggccagcctctcaaaacgtccatatcataggccatatttcttatcgcgatgttcgtgcatttgatcttcgtcatattggtcaccatcaaattacagatcctgaaagcacaacagcatacgatgtcacactcattgattgttcagcagttgaaccagttttcaactcgctttacgatgctgtgaccccaagagcgctggttatttcggcatataaaaacgttaatgtaagcggattcacagcgattggtgatccagactatgattataaagaaaaccctgtcgtagccttgcaatatcgcagccaaaatataaccattaatggtattaaaattcgcggttttaaaaaagccggtgttgatattaatttatcaggcggatcaaataaaactgattatattaaaatttcaaattttgatatttataaatctgctccaaaaggaatttcaatcggtggaggcctctacaatgtcaatattctaaatggaacgatgattactgacaatgggacagttgcaattcagtcccccaataatcaggccacaattctcggtgtacaatcagaaggttatagtgtggcagcctcaatcaaaggccaaacataccaacaagttccaatcaatttgaaaggaggcatacagcttgcaacgacctctggctttgccgttaaccaaacaagcgcagttatagcaggtaccggcgacattacggcccgcggagaaagaaatgcggtcattagctcttctggaggctccagtactgaaggctctcgcgcattaatcgcttcttcaaataacgcacatattagaggaaaccaagcgtcaagaacaatactgtcttctgaaaatattatacttgaggaaccatacaccgtggcaggaggtcatcaatcaataaagtggcttcttgactctgttcggggaaacgggacgtttgccggtgcaatcagttcttctttaggtggatatggagagtattttgagagttcaactggacagttaatccatactggtacaatcgtgactttaagaggtgaaaaaattgtgcccgcgaatgttggagattatatgcttggcgttatttcagaaacttcagctttcatttcaggagcctccagtttcgtctggcagggccgttatttgacaaatgagttcggcggatttatttatgaaacggtgactgatgaggaaagcggtgaactcatacgtgttcccaaacaaaatccagactacgatacagcgctggaggcaaattatcattcacgggcagcaagagacgaatggcacgttgtagggttggttggccaacattatgtgcgtattgacgaaactgtcaatcaaggagattatcttacggcacataatggaataggaacaaaagccactgaaggaagctggaaagtaatgaaaataacctctgcttacacatcagaaaaagggtatggtatcgctctaaccgtcatcaaatagtggatacgccgaccagttcaatatatgtttatccaaataattagatctcttttctaggttctttattccttgtatgttattatcaattttcaatatctaccaaaacacccctaatatactatcgtaattaacttatattataatcaaaaaaattttgacagctgttccttctcgttattcatgaaagttgctattgaaatgagtaaatggatatcatattagacttctatagcaaatacaccatatatatcctttaagtatttacaaattgaaaatgtttcatgaggcttattaaaagtattgttcttttatcatctgtaagtcgatacaaattgcattaagatcacacctaaatcacactgagttttttcttacaaaaaaatgaaaaccctttccattctaaattcatttcaccgttactaaaagtaatccttgcattccttcgcccttcatgctatattcatatagcgatgagctgaattgtgtaagtcgatgtacatgcctttacggcacacacgaatgtggcgtgtggtgcatcgcctcaatacgcaaagacgtttgccttaggcaaacgtcttttttgtgttatccgatttttgtgccgtttgaaacaggctgatccggctgcaaaaggacgacatcgccctggccgggtatgccgccgaggaccaagacttccgatttaaatccggcgatccggcggggcggaaagttcacgactgctatgacttgcttgttgacgagaccttccggctggtaacgcttcgtgatctgcgcgctcgattgttttatgccgatttctgtcccaaaatctattacaagcttgattgccggtactcttgcttcaggaaattcttccgcttttacaattgttcccgttctgatatccaatttctcaaagtcttcaataactgccatatcaataactcctttttctcctattgtaaaggagatatacaatattcttttaactaaagagccatcattttttatccgaatataaggtgtttcgatacaggcggggcggcattcctgtgcttttcgtgaaccatcttgtaaaagaagaaaggttttgaaagcccagcgcctcgctcacgacggtaaggttttcatttctctccatcagcattcgttttgcttcctcaaggcgaaggtcggcaatatagttctgcggggacttccctgtctgttttttgaaccagcttgaatagtaagctgggtgataatgctcgatttctgccagcttcttaatcgtcagccgctcaaataaatggctgtgaatgtatgcaattgaggcatagctatgggattgaagcttttcttttatgtattgtactagcatatgaagcgagttggctgttccggcctttgcttcctctgtcagcaagtacctgatcgaagaccagaaaggatcgagtgcagcttcaattcccgatcctgcacgatactcatcaattttcattgcgtgaagcggaacatccagtacaagacattcatttcttccgatagaacggaagcgatgctcgcactgcggcggaatatataaaaaatgatccggatttaatttcacctggcgcccctcagtctcaagatctatactcccttcaagcggaaaaagaaattggctgtacgcatgcttatgtgaatgataaaggcgtgtgtatgtccgtttttcgcaaatcatctcttgaagcgaatccatcagcaacccccttcctttggtcatcttttaatccggtaatggtgttccgatataggcgaaaatccgattttttcatataaagaaactgccgccagattttctttcatcacttgtaaaaacatgcgttccgctccgttgttttttgcccattcagtcaacatcctgatcacttgggttcctgccccttttcctctgtgctcctcagctacaacgatattactaagtccgccataaccatcaatgacagaaaccgtgccaagcgctgtcaggctttctttgtcatacatcttgaaaaaagttttacacggcggcatgcgttcgaatatgtgtttgtaacctttgtgacgttcgggtgaaaacccttctaattgaataaattcatctatccaaacagatgatggctcttgttcccacttgtatgtaaatcggctgttgtcatttgttcggctcataattgaccggcacaacgctgtcatctggaagcactcgtctaccttttcataacggctgtctgccaatgcgtcatcaagccctttcggtgatgcgttgctaatatgaaaacaaacaggtaagcctaaactttgataaaaaagttcggcctctagctgaaaatccccttcaggcatatccgcagacgtccatacgctatttgcccttttggttacgccaaaattcgctctgagaagccatttccctatgcttttttgaaaataagccggccatgaagctgccgctaatcgttcaatcttgcgaatgtcatccattgcataatgcctctcccctatgtatactcccttgatattatacaatattcagaaatataagacatccatttatttgtttacataatatttttattgtttattaataatcctgacaaaaatgtccgaattgaaaatgacaggctttctaaaatgtcctcctcacgttcaaatgcttcttttgcgattaaaacagtaaagccatgcagcagacttctgagcccccttgtcgcatgaatggcagtcttttcacttgcatagccgttttcaatgagcagcttcgtcacaagacagacaatttggtcagagacgatttccgtccgtttgtcgtgaaccttaagaagagccgcttcataatatccgggattttcaattgcaaaatcaacatatgcatgagctaaagaaagcatcgcggaatctccctttcgttcggttacggagtccgccatttgatcaaaaagctttgtcagtcctctgacagcaagttctgctctgatcgcttgcagcccgttgatatggttatacaatgacggggggcgaacattcatttttttagaaagtgcggcaagtgagacaccatttaccccttcctgatcggcaatctctgctgcagcgtctacaatcattttttgggtcaaacctattctcggtgacatgctcatcatcctttctttgctttttggatcgcctgtctcatccgctctgaaggtgatcgcaggaattttccatgtccgacagcgagacaggaaggcgccttatctgcgagcaattgtgcacttttgatggcctcctccttattccatgtggcgaaagcgggaaaaggaaacgtccattttatctggcctgatacagcgattcctccgtgcaactgaaacgcatctcctgctattaaagtgccgtttcttgtatcaagaaatgacatgctgcccggtgtatggcccggtgttggaatggcaagcagagaaccaattgtttcaccgcccgtcagcagttggtgaggctttgtttgtatgtgtttcggaatacctccttttataggcgtctgcggctcatcttgccgcaaggatgtgtcaccttggagcaagaatgaatcccgttccgagatcatgacctttgcatgcggaaatgtttgtgccaatgtatccagtgatccgacatggtccccatgtgcatgagtcagtaaaatatgctgaagcggttttccaagctgattcacagcttgaataatccctttatagctgcctggcagtgcggcatcaataagggtgacttcgttttcttcctctactaaatagcaattaaccggaaacaatgctggaaaaaaagtcagctgccaaaccgtttggtactgagtcattctcatctttttattcctcctaacaaaactaatggcgttagttttattattaactaacaccattagtttttcaagagtttattatttttttatcgctacataaatgttaacttgtgctcgctgtggcactgcggcactttgatcatacatctcaaaatcacctgtaaacgtgcgcagatgccgcttatcccaagtccaaatttccttccacgtttcaagcacaatctcttcaataggaccgattctggaagtgaaaacggcgtaagcggaagccggcaaatcaatgttttcatatggtcccggaagaatgtcgtcgtattcctgaaacgttccgactgaaaacgtataaaacccattcgtctcttgttcataattcgaatataaggcaataatgcttttgtctttttcagcctgtgataaaagagcgctcatatcctgcttccagaattggtcccacagtgccggaatcctcctttcttccgtcatttccagtgcgttgcttgtccgttgtgacagtccggcaaatcgtttccggtctaagtgtgttatatgtgaaaagcccatacgatctcctcctttttttaagattatagacaaagaaacctgacagcagtgtgtcaggtttcatatattttttgcatgtgatgaatggtttcttttactttatcccgtatatgaagaggctgcagaacctcaatatcctttccgaactggagcaaaaaaccgatcagccatggatcttctggaagtgaaatcactgcccggcagatttcatcttcctcacaacagtgaaggacatcatatccgaaccattcacctatgcgctgacgtgctgacggctgaacaagaataaccaattcagttaaacggtccttttggtaccaactcttatcccatggcaaagtgtccagctgaatgtcttttctgataaatgtctgatgtaagatagccagatctttcatccggttcagtttaaaaaagcgaaaatcatttcttaccaggcagtaggcatataaataccagtgccccgccttgcaaaccaatgtataaggttcagtttcccgaagtagtgtttccccgcttgcgcttgtatatgtaaaagatatcgttgacaaccgatcgatggcagcgctgattttctcgcgcagcgtcttttgatcctcagtatggccccaagccgtcatgtcaataaaccatttttctgtttggtgcttaaatgcttgagtagattgttcaggtataaggtgtttgattttttgataggctgtgctgtgagaaacgggttcatacatagatgaaacgctttgcaaagcagaagcaattgcaaacaattcctcctccttcagccactctctttcaagccgatacgtttccatgatgccaattccgcccccggaaccctgtgaggtcacaatcggaataccagccctattgatcgtctcaatatcacggtaaattgttctgacagatacttcaaacagctcagcaagctctgcagcctgcacttgttttttgctgatcaataacacaaccatcgctaacaaacgttccagtttcattctgcgcaccttttcttcttgtattttccaacaaaacaatcataacattttgataaagcttgggcatatctattatgcggcggaatacacctcgcatatgctatgaaaaaaggggtttccccttcttttttgtgttcagtatttatttcagctactatttccgaccggataagcatacacttctcaacggaggggatttcacatcatgcatcttacacttcagagcgtttatcctgccatgatcatcatcttttttctgtataaaaaaattaaaaggtccatcggataccagccgctgaagccccgctggctgttcacccgtatcattcttttctcgctgtttgcttttggactttcaatcttcagcgccattcacccttttttatatggatatctcattttgggcattcttggcggatggctccttgtctttttcgctaagaaaaacatctcttttgaaaaacgcagaggaaagatctattttcggactcatatttgggtagaaatgattctcctaaccttattcctgtcaagatttctatatcgagtgacagagctttatcttacctcgcctgatctaaacagccttggatcttacggtcagtcaatcggaacggaccctctgacaataggcgtcttttttctgatagccgtttattatatcggtttttcttcttttgtcatcaagctcagcagaaacgaactcgaacagcacggacacaataaagaaaaagacatccttgcccgctagcagcgagttaagcaaggatgtctttttcaatcatgctgcgtatgatggatcatttgctgaagaacatctaaaacatgttcatcctccggagagtaataaatcgatgttccttctctgcgcgatttgacaagccgaagatttttcaaaaatctaagctggtgggacacagtggattgcagtaaattcagcttttctgcaattccgtttactgcatgctcaccctgggacaataaatggagaattctgattcgggtaggatcagaaagcgctttgaatgtttgcgcgactagaaacagcgtctcctcgtccagatcagcagccgattgttccgtttctctaaattcagtcatatgtatcacctttctttattcatagttttatcttataacaaatgcgcttgagtgcaaaccagcctgcttgtattccatttcaatctcatagtttaaatttatgtttcaaatcaggtttttacttggtctgatataccgtcttatgtcataataaaaaaggtcatactgctccaaacattgagggtgaaacacagtgaagaaaaagagaaaaggctgtttcgctgctgcgggttttatgatgatttttgtctttgtcatcgcctcttttttattggtcctgctttttttcaaccgggatttaatcaaaaaacttccgatcgatacgaaaacgattgttttggaacgtttaaccgattacaaacccttggtggaagaagagcttgaaagccaaggactctctaattatacatcactcatattaggcatgatgtatcaggagtcaaaaggaaaaggcaatgatcccatgcagtcctctgaatctctggggttaaaacgcaatgagataacagaccctcaactcagtgttaaacaaggcatcaagcaatttaccctcatgtacaagaccggtaaggaaaaaggcgtggatttggataccattattcaaagctacaacatgggggcaggttacattgattttgtagctgaacatggaggaacgcatactgaggaattggcaaaacaatactccgagcagcaagtcaaaaaaaatcctgacctgtatacttgcgggggaaatgcgaaaaatttccgctatccgtattgctacggtgattatacgtatgcagaaaaagtaaaagaaaaaacaaaaactgttgaagaatctttgcaggttgcaacacttgaaaccatggaatccaaggctcatgaataagagtctatcaatttactgacaaaagcccaaaaatgaatttgggcttttgccatgtttacacgtaaaaaaagccatactgagtatggcttttaataatacggtgaaatcatcaaatatacaataacgcctgtaaggcttacatacagccatagaggcattgtccatctcgcaatttttttatggcgctccacctgcatgctgaagcctctgatcagcgtaaacagcgcaagcggcacaataattgcagaaaggcagatatgtgtaattaaaataaagaaataaatcgggcgcataataccttctccgccatagagcgtgttttccgcaatcgagtggtacgtcacatagcaaatcaaaaatagtaatgttgttgtgaacgcagccaaaataaagcgtttgtgagctttgatatttttctgtttaatcataatcagcgcggccaataagaagataaacgtaaagctattgaatatcgcattcagcattggcaaaatgtgaatattcgcatggctgaactgatctaatttaggcataaaaaacagcactgcgattaaaccgttaatcagaactgtcagcgtaaggacaatccccgtgtaatttttcggtttattttctgtttggttcatttggtgacctctcctaatttgtactggctatccaaatcgtatgcaaattcaaagaagatgtcaacggtttcgattgcttcgtcagaaattagacacacttcaaaggccggaggctattagccccggcctgttaggtttacgcctcttttatcaaatgttcaatgaccttatgttcattttcattcagcaggttcttttgaattttcgaatgaatgggtttattcatatgctgatccaagatatcggccgtttctttatccccggcaataaccattcgttcccatcttttcgcggcagctttttgatcaaggctggcagccagccgcttatacagtctcgattggttctctgttacatgttccctcatccggttctcttcaaatggtggcgctttgtctacagcggaatggctattcttccaagactcattgatcatatcatactcataacgctccaccgcctcaatttttcctaaaacggtttcaataattttcacttcatgctgctgagttaaaataaacgccgtacttgggtatgcctggcgcaaacccttcagctgatccaggacagctgtttcttcccagtaaaatcttgtatctacagggacttgaagcttaataggctcccatatgccgctgtcggaaacaaaaaacacgagactgcggggcatgtcttttcccattgcattcaagtattgattcattttagccctgattccatccagacacttttcctcctctggatcactagctgccaaatactcttttaatcggctgaatcctgactttagggcaatcttccattctcccccctgctgctctggatctctcatgtctgtattgagatacagagagagaattttatccggcggttccaattggacatactgtaatttgttaatcaatgaatcaatcgccattccgattcctcctttttcacaggttagttttctttttcctctcttaaaaacgatcaaacctgactttccgctaatttctagtaataatggaattgttgtttacaatacgcctctcttctaatacaattggtaactgtgtttctaagctgatttttgaaaggagtttgatcttgtttactattaaagaaaaaaatcgtcaagagcttgaagaagaattaaatgatttagaatttcaaatttatcgcatgcaggagaatatgaaggatttatctaaagatgccaaagtgcttggtattgatcaatcgaaacatgatgagtggatgattgtttcctcgattgatgatggccaaacatgcaaaattatgctaactgattgtaaaacggcttaccgaggaaaaggctgtttttcacttgtagcgtcttacaaggacgatgccattcatataggcgatataaaaggccctccgaatcacgggtttggttccatttgcatgaaatatttaaaagatatagcaagagaccacaatataccgaaagtcacaggagacatcgccaaacgggattggaatcatgtagaccggctgattcacttttatgaaaaacatcaattcaaagtatgtatcgatcatgatacccaatccggcagcattaagtgggttgatttgtaaaaaagtctggaagaaagagccaagatatgctgtaatggtaaaaaaccattgatggagggttctatgtacgcctcaaaactgaaaaagggagacgaaatccggatcgtgtctcccgcgaccagcatgtctatattatcaaatgaagcaaaaatccgagcacttaggttatcgggtaaccatcgctgaacacgcaaatgaatgtaatgaatttgattcatcctctatcgagtcaagagtccatgatctgcacgctgccttttttgatccaggcgtcaaagcgattttaacgacactcggagggtttaattcaaatcagctgctgcgttatcttgattacgagaaaatcaaacggcatccaaaaattctgtgcggctattccgatataaccgctctttgcaacgcaatttatcgaaaaacgggtcttgttacgtattcaggcccccacttctcaacatttgcaatgaaaaaagggcttgattatacacaagagtattttctttcttgctgcgcttcggacgacccgtttgaaattcttccttcaagtgagtggagcgatgaccgctggtttttggatcaagaaaacaggcgtttttatcctaataacggccctgttgtaatccaagaaggttatgcggaaggtactttaattggcggaaacttatgcacgcttaatttgctgcagggaacggagtattttcccgaaacagaacatactattttattgattgaagatgattatatgtcagacatccatatgtttgaccgcgatctgcaatcactcatccacctccccgctttttcacatgtaaaggcgattttgatcggcagatttcagaaagcatcaaacgtatcaatggatcttgtaaaagccatgatcgaaacaaaaaaagaattatccggcatcccgatcatcgcaaatataaatgccggacatacctcgccaattgccacgttccctataggaggaacatgcaggattgaagctatttcgggtacatcacgaatatggattgataaacattaatcagcttgtaaatttttttacaagcttttttagcgcaatcggttatgcatgccgcacgagacatgacaaatgtcatataggaggcatgatgtgtgctactacaaaagacttctctcattagcgtatactgaaccgagacacacaatgagaggatacttactatgactgaacaaaccattgcacataaacaaaaacagctgacaaagcaagtcgctgcatttgctcagcctgaaacaaaaaacagcctgattcagcttttaaacacgtttatcccattcttcggcctatggtttcttgcttatctcagcctcgatgtctcctatcttcttacgttagcattaacggtgattgccgcaggttttctgacaagaatttttatcatcttccatgactgctgccatcaatcttttttcaaacaaaaacgctataaccacattctcggttttctgacaggtgtcctgactttattcccgtatcttcaatggcagcacagccattcgattcatcatgcaactagcagcaatctggataaacgcggaacaggagacatctggatgttaacagtaaacgaatataaagctgcatccagacgaacaaagcttgcatacagactttatagaaacccgtttatcatgtttattctcggaccgatttatgtttttctgatcacgaaccgttttaacaaaaaaggcgcaagacgaaaagaacgtgtaaacacataccttacgaatctggcaattgtcgcgttggctgccgcttgctgtctgatctttggctggcaatcgtttttactggtgcaaggcccgatatttctgatttcaggttcaatcggtgtttggctgttttatgtgcagcatacctttgaagattcttattttgaagcggatgaaaactggagctacgttcaggctgctgttgaaggcagctcattttataaactcccgaaactgcttcaatggctaacaggcaatatcggttaccaccacgttcatcatttgagtccaaaggtgcctaactataagcttgaagttgctcatgaacatcacgaaccattaaaaaacgtaccgacaatcaccttaaaaacaagcctgcaatcactcgcgttccgtctatgggatgaagataacaaacagtttgtgtcatttcgggctataaaacatatacctgtaagccttccgcctgattcaccagaaaaacagaaactgcggaagaatgcctgatgataaaggaggtcttctaatatactagaaggcttcctttttattgttggagggtgcattctggctttcacaatgataaagttacaagtaagatgaaaagctgaaaatgaggtaagatcatgattaaaaatcattttacatttcaaaaactaaacgggattacgccctatatatggacgatatttttcatcctccccttctactttatatggaaatcatcatctacatttgttattattgtcggcatcattttgacgcttttatttttttcggtatatcgatttgcttttgtctcaaaaggctggaccatttatttgtggggatttttattaattggcatttcaaccgcctccattaccctgttcagttatatttattttgctttttttatcgcgtattttattggaaacattaaggaacgcgtcccttttcatattttatattatgtccatttaataagcgcagccgtcgcagccaatttcagtctcgtattaaaaaaggaattctttctgacacaaattccttttgtcgtcattaccctcatcagcgcaattttattgccctttagtataagaagccgcaaggagcgcgaacggcttgaagaaaagctcgaggatgcaaatgaacggattgcagaactggtaaaattagaagagcgtcagcgaattgcccgcgatctccatgatacgcttgggcaaaagctttctcttatcgggttaaaaagcgacttagcaagaaaattgatttacaaagatcccgaacaagcagctcgtgaactgaaaagtgttcagcaaacagcgcgaacttctttaaatgaagtaagaaaaatcgtttcctctatgaagggcatccggctcaaggatgaactgatcaacatcaaacaaattctcgaagcagctgacattatgtttatctatgaagaagagaaatggcctgaaaatatctcattgctgaatgaaaacattttgagcatgtgcttaaaggaagctgtcacaaatgtcgtcaaacacagccaggctaaaacttgccgagtagacattcagcagctctggaaggaagttgtgattacagtgtctgacgatggaacattcaaaggagaagaaaattccttttcaaaaggacatggcttactcgggatgagagaacggcttgagtttgcaaacggaagccttcacatcgataccgaaaacggaaccaagcttaccatggcaattcctaataattcaaaataaacataaaggatggcttatatgattagtatatttattgcagaagatcagcaaatgctgctgggcgctttaggatcacttttaaacctagaagacgatatggaagtcgtaggcaaaggtacaaccggccaagatgctgttgattttgtcaaaaaacgccagcctgatgtatgtattatggacattgaaatgcccggaaaaacagggcttgaagctgctgaggagctaaaagatacaggctgcaaaattatcatcttaaccaccttcgccagacccggttactttcagagagctattaaagctggcgttaaaggctatttgttaaaagacagtcctagtgaagagctggccaacgccatccgtagcgtcatgaatggaaaacgcatctatgcacctgagctgatggaggacttatacagcgaagctaaccctcttacagatagagaaaaagaagtgcttgaacttgtggctgacggtaaaaacacaaaagaaatcgctcaggaactcagcatcaaaagcgggacggtgcggaattatatctcaatgattctagaaaagcttgaagtgaaaaatcgaattgaagccattacccggtcaaaggaaaaaggctggtttaaataaaaaaggatcttggcatctgccaggatcctttttgttaacctgaaattccagtttgagaacctcgccgcaaccagaattaaattgatcgatatcctcgctcctatacccgctgaacgattgcttgattaacagcccaataaaagactggattgaatgatatccctgttaaaatggtcggccattgcacatcagcagaatttctgatattgattattttgtattttcagtatgacaaagttgtgccacttcgctcccgaagctgccatgcccaactgcaagagcttaatatcacaataaaaaaccgtctgaaatcaatccgattccgttccgtaaatggcatctgctacatccaactgcttattatctgccaaaaaagatacaacaccagctcgtttcgctgatcaaagatagtaacaaccagctataaatgtcatgatgccgaatgtctctgtaatgtggaaccaatcttttaacccgagagcccctgaatcgcacataaagagaaaaacgggaccactttcttttatcagcatatgatataaacagctctaagcagaacaaaaaaagacacaagccaaaagctcatgtcttttatcacaatctatattattagtttaagactttaacacttacagttttgacgccccaattagaagcatcacttttacttggtacaaatacgtcgattttatttcctttaatagcgccgccagtgtctgctgctgttgcttccccgtagccttcaacatagactttagaacctagcggaattacattaggatcaaccgcaataactttcgcattcgggttcttatttaagtcaatgcctgtagctgtaacgccggaaatgccgccgtcgttagcagtgtaagcagtagcagtaactgttagttcttttgaagcttcttgattatttgtatttgattgaacagccttctcctctgtgttaacagaagtttctgcctcagcctttgtttcttgtttaggttgctgttgtacagcttcttgtttaggttgctctttttgcacagcctcttgttttggtgcagcttgaggtgcgtttgtttgcgcattctcagtagctgtgtttgctgctgttgcctgaccttttactgaaagagttgatccagcatagatcatgtcagagcttaagttattccaaactttcaggttgttgactgtcgtgccgaatttttgagcaatcttagaaagcgtatctcccgctttaattgtatattgcccagtcgtggttgtttcttctgaagaaatggtcagtttttctcctgcaatgattttatcagaagttaacttgttccattcttttaagtcctttaggttcactccatttttctgagagattccccagagcgtatcacccttttgcaccgtaatttcttttgcagaagcgtgagctccgaatgcagttgttgaaagtgcagcaactgccacaaaggacataatcgtcttcttcataagtaaatcctcccttgttagctttttattggcggctaacaggtgatatcgtaacacacgtaaatgtcaaatcaataacaaaaagatatgatttagattacagttcctttacatgaaggatttctctctgatggaaagacttgctgaacccttgatataataggcttcgcaggtctttttattttgaggcgaaacagagaaaataaaatgtgttttttatagaaaaaaagattgtttttctgtttttttagtctgtcatccttgcataagcttgtatttcttgtaaaaaaagccggccgtattttgctcttttttgttctccgactccttttatagacaaaagttcatcatcatttacgggctgttttcctgacatttcttttaacgtttggtcagagaaaacaacaaatggcggaacaccctgctcagccgcaatttctttccgaaccatgcgcaatcgttcaaacagctcgtcattttcagtaatcgaggccgcttttagcgcttcttttctcgttactgataattctcctctcagcacattccttcctttactgctgacaaaaagagtcggaaacgttccgtctgacatcctgatgaaatcgtcagaaataagaaattcgataaaatcactgatttcccctacggattgatgttttaatatcccatatgttgagagatcggcaaagccgttttcaagaacttttttatttttagatccggcgagcacttgggcaaccatcatcttaccaaagcgttccttcatgcgaatcatacacgataagaccatttgcgcctcccgtgtcacgtcatgagccatccttgtatcagtgcagtttccgcactgtccgcacgcatcaggctccttttctccgaagtacataaggataaaacgctgcagacagtcttccgtgtgacaatagtcgaccatttgcctcagcttttttaaatcctgcttttgtttctcttcatgttctgattgttcaattaaaaaacgctgcactataatatcctgcggtgaaaacaggagaacgcactcgctgtcaagaccgtcccgtccagcccgtccggcctcttgatagtagctttccatatctttcggaatttgtgcatgcagaacaaatctgatatttgatttatcaatgcccattccgaaagcagaggttgccaccatcacttgcagctcatcattaagaaacctttcctgctgctcttttctcacatcatcagccaagcctccgtgataccgccctgcattgacccgatttctttttaatcgctcataaatccggtcagcttcttttctggtcgctgtatagataatgccagcttcatgtttgttgttttgaacatactcgtcaataaaacgatccttattttctccctttgctactttaaaggttaaattgtctcgggaaaatccggtatatacggtgttttctttttgtatgtgcagctgtttgcagatatcctcgtgtacctcaggggttgctgttgctgttaatgccatgatgacaggattgtcatgtaattcacggaataaaatttcaatatttctgtagcttggcctgaaatcatggccccattgagaaatacagtgcgcctcgtctattgcaaccaaagggacatcaatgccctgcaaaatccgaataaactccggtgacgttaatcgctccggtgtaatgtaaaatagcttataggccccttctttaagcccagtcagcctttcatatatttcctgactcgattgtgtgctgttaatgtacgcggccttaatccccgcttcttctaacgcatcgacttgatccttcatcaaggaaatcaacggcgaaataacgatcgtagtcccttcaaacatgagtgccggaatttgatagcaaattgatttgcctcctcccgtcggcataatgcagacggtatttcgtctttcttccgtcaccgagcggatcgcttcttcttggccattgcggagcttttcataaccgaaataatgggccagaagggattgggctctatgtaacataacgtataaacctcgcttttccttgaatttcttccatcatatcataaaaaaacggtcttcatttcttccacacagaaattgaatttttgctataccaaacctttttaaataaaataaaaagccatttcccaaaaggaaatggctttcgctacgtcttgccgtatgcaagtaagaaagttttaaaccaccactcctcaaagtgggtgtttgcagaaacgttcctgtcgtcctctgcaatggaggcatgacattccggcttcgatataaaactccctattacagcttaaaggttaaaacttaattaacaatacgcacaaagtagcttcttttatatagtacaccatcagcagctttttatcaagagaccagaacaattgtttagaaaaactttttccagccgataaaaacgatttttcgctattatatccggagattcgacaagtcaaaaatatattacaataaaaaaacagccttttttcgcaaagaggattcatcactttcttctattataatatgtatacaaaaaaactcctatcgcccaatgataggagtctttgtttcattagaattttgcagcaagatcttttgcttcttgtaaacctttttcaatgatttcttgcgcttgatcaggtgctgcgttatgtccttcgatgacaactgtgtgcaagtcttgaacaccccagaaaccaagaactgttttcatgaagtttaatgacatttcaagtgcagccattggtccttctgagtagacaccgccgcgagcgttaagaagcgcaacttttttgcctcccattaaaccgactggtccttcttgtgtgtatttgaatgtaacgcctgcgcgagacagataatcaacataagtatgaagcactgctggcactgtgaagttccaaagcgggaatgcgaaaacaactttgtcagcttttacaaactggttcagatatttgtcagcaattgctgcttgttttttctcatcttctgtcatttccattccttgacctgctttaaatgttccgttaatcatatctctgccaaggtaaggaaggttttccttatgaagatctaattcaaccacttcatcattagggttgttttctttataagcagctaagaaagcttcgtaaagtttagttgaaacgccttcttcagctgtacggtcgcttgattttacaaataaaactgtagacatttgtattcctcccggtaaactttttatatttacttacaaatagtatgttactttcttttttacgtaaagtcaatcactttattttgaatatgagattttttttcaaaaaaaagcaagtacatctaatatcggtgtacttgcttgccatttttacttcgaatcttgttcacgatccaagatttcatacgtctgcgagcttttttgatcaattgtttctttgttggataagtcttttacctgttcatgaaactctctttcataagaaggagcatctgtctccagatcatcctccacattagcttgagcctcaactgtcattcttgcatagggaacagcttcaagtctttcgtaaggaatgtcttggccggttttttcacacacaccgtaagttccgtctttcatcttttgtaatgcacggttgacctcctctaacagctcccggtcaatctctttcactgtttggtctgtcatccggtctgtgacgagcgtcccgtggtctgccatatggttgtcaaccccgttggaaagctcccccacttcttccgtcattgattctgtttcctttttctcgccagacaattctttttgcatatcgagcaatttatgatagagatgctgtgtttgttcttttgtcagtgccatgtatatcctctcctttctatcctgtttcccgttttgccttctgtcaaacatggaaacatcgatggaaagaagctactgcctttttgaacggatcgtgaccgctggcgtcgatggtgcttcgggttttcgttggcactttttgtccttctcttctggcggtatataataggttgcgcctatatttaatctgccgctcagttcatcaatggtcagctcgccgaattcaagatgatagtcaattttttcgacattcagcgtttcaatatgtatataggtttcttcagactcctgtttgctgctttgtttttgtttctcaatcactgagagtctttcttcacattcacgcagtttgtcaagttctggtttcaagcaaagcctgatcagcgaccggaacatttttttcatgacatcacgaccctttgcatactcctctttcgtctacatatataatgaggtatataccatagaaaggagaggttttcatgcttccgactaacatcaatatttctcatctcaagactaactcgataggcaccggctcatcccttacctttggttctgcggagttaaggaacaggtgctctgctatcaaaagaaataacggttttggggaacaaaatgcagatgttattgttatggtcattccgattgaatcaattgatgaccgtgatggagcagatgcactcagtatgaaaatcaatcatcaataacaatggttttcgcttgaccttcgtctttttgaatagtgatgtataggattccgtctttaaaaatggcattcatctttccatgaagatgatcggaaagctgaattttcttctcaaaacttccgtatttcccttctttttggcgaaagtcctgttcattaaaataggaaaagcgctgccccttcaccactaaataatctccgtacgataatatgtgaacgtcttgtttacggtagcctggaagataaattaaaaactgcacttccgcaacggtatctacaatatccatgctcggaaatgaagcatctcctttccctcgctgatcttgctgcgcaaacggaaacggagattggccatttgtcataaaaggggttttttggtcttcatcaaatacctgtttccaaaagtcaccgccgtacatctgctgtgcgaattccatccactgcttcatcttttcgaaatccatttgaagccccctgtcttaacatactttataaccgccagcatacaactatagaaaggaggtttgcctgtggttcaaccaactccgtatatcaatattaatattttcatgctgaaaattaattcctttgaaaatgcttcagcggttaacgtaggacaaaatttattggcagaatggcaaaattcagataaaaaaaatcaaggctacggacagaattttggagatgcgagcggatttatgggcacgagaagccatgtggatgacagagaccaaattgattctccggcctcttttgaaagtgaagcggttaactcctcaatcaaaaggaagtgatgagatgttcttttcaccctccgtcgtgaatgtcggcggatttaaaatcaatacgatggatcgaggttcctctttaacactcggtccgtatcagcaggtcgattactttttatcagctaaaataaatcaagggtttggagaagaaaatggcgactttactcctcttgtcgtaccgatttcaaatgtattagatgcagatcttgttgattcgaactcagcgaaaaacagtgtggtgtaataagaacagggcgcacatgccctgttttttttataaaaaaaagcctaaccattttttgaacggctggctcatcaaatattcagctgcacaaatgctttgtcagcaccgcctgaacctcgcttaaatcggtgtctttcgcaaattctaattcgaacgttttgcttcttgtcatcaataaaagcccagtgtccggatcaaacattcccgcttcttgaatggcaaagctttcaattgttttatatggaagaaatacacgaaccttctttttggaaaacattttattgtcaaagaaaatgatccgcttatttgtaaagcaaatttggtccactcggagcttataaatcgattctattctttccccttcaacgagcaaagcctcaagcttctttgcgtccgttgatctgctaacagaaaaaatacccaatgaagaacccctctttctgcatttatctatttgttttatcattcactacataaaaataagtcctttatccctatataagaatacgacatagaagacatttaaaccattacgaacagattacatttttcaaatttttgatttgttttttggcttttaagctgttgtcatcaagtaatacgcacatatagagaaaaaagtttcaatattcagcaatgtttttataaaaaagcggtttttaatgatttttttaattttgttttatatttcctgttttaaccacaaaaaaaccgcagctgagctgcggttttatgtatcgactgcttttaacaaaatctgtttgatgcttcaaggaagcattacatctcttcgaagtattctttataatagccgccgactttattcgtattgtcgaccacaaagagaaactcctctgtttcattttttacttcatattcttttcccggcgttaaaacgcggtttacgatatatttttttgcgtttgtctgcacacactttacttttttaattgtttctttttcaagccaatttttatgaatcatgatgaaatctccttttcttatctataagcttattgtagcttttttcttttgtaaattgcaatatcggttattcattgattttgccttgatttctattatagaatgtttgtatacgcttacgtttgaagcaactatcacagcttatttctgctattcaatccaggaatcaatgtgctatcaccaagaatctcagaacagaccataaaaaatgactggaggtttgttacggatgagttctttaacgatgcaagtgacgaaaaggctggagacatttttacagggaacaaagaagctttatattgacggaaagtttgttccgagtgcctcaggggcaacctttgacactccaaacccggcgaccggcgaaaccttgatgacgctgtatgaagcccaggctgcggatgtggacaaagcggttaaagctgcccggaaagcctttgaccaaggtgaatggagaacaatgtctccagcttcgagaagcagactgatgtataagctggcagacttaatggaagagcataaaactgagcttgctcagcttgaaacacttgataatgggaaaccgatcaatgagacgactaatggagatattccgctggctattgagcatatgcgctattacgccggctggtgtacaaaaataacaggacagacgattccggtttccggcgcttattttaattatacgcgtcatgagcctgtcggtgtcgtcggccagatcattccatggaatttcccgctcctgatggcgatgtggaaaatgggcgcggcacttgcaacaggctgtacaatcgtcctcaaaccggctgaacaaacaccgctttcagctctttatttggcagaattaattgaccaagccggtttccctgccggtgtaatcaacatcatcccaggattcggtgaagatgcgggagaagcgctgacgaaccacgaagcggttgataaaattgcctttaccggttccactgaaatcggaaagaaaatcatgtccaccgcagcgaaaagcattaagcgtgtgacattggagctgggcggaaaatcgcctaatattcttctgccggatgcgaatttgaaaaaagccatcccgggcgctttaaacggtgtgatgtttaaccagggtcaagtctgctgtgcgggctcacgtgtcttcattcataaagaccaatatgatgaagtggttgatgaaatggcgtcctatgctgagtcactccgccaaggagcgggacttcataaagatactcaaatcgggcctctcgtaagcaaggaacagcatgagcgcgttctttcctatattcaaaaaggaaaagatgaaggagcaaaagcagtgaccggcggaagctgtccttttgaagcaggatattttgtcgcaccgactgtgtttgcgaatgttgaagacgaaatgaccatcgcaaaagaagaaattttcggacccgtgctgactgcaattccgtacgaaacagtcgatgaagttattgaacgggcaaaccattcagaatatgggcttgcagccggactatggacagagaacgtcaagcaggctcactatatcgcggaccgacttcaagccggaaccgtttgggtcaactgctataatgtgtttgacgcggcgtctccatttggcggttataaacagtcaggactcggacgagaaatgggatcatatgccttggataattacacagaagtcaaaagtgtatggataaaccttgaagactaacatgtatatttaaaaaactgctgcctgccagcagtttttttctttctgtaatggcggtaaaagacgctgaatatatatgcttctgaaggagttgagcgtgatgggcacacttcaggagaaagtgaggcgttttcaaaagaaaaccattacggagttaagagacaggcaaaatgctgatggttcatggacattttgctttgaaggaccaatcatgacaaattccttttttattttgctccttacctcactagatgaaggcgaaaacgaaaaagaactgatatcagcccttgcagccggcattcatgcaaaacagcagcccgacggcacatttatcaactatcccgatgaaacgcgcggaaatctaacggctaccgtccaaggatatgtcgggatgctggcttcaggatgttttcacagatctgagccgcacatgaagaaagctgaacaatttatcatctcacatggcggtttgagacatgttcattttatgacaaaatggatgcttgccgcgaacgggctttatccttggcctgctttgtatttaccattatcactcatggcgctccccccaacattgccgattcatttctatcagttcagctcatatgcccgtattcattttgctcctatggctgtaacactcaatcagcgatttgtccttattaaccgcaatatttcatctcttcaccatctcgatccgcacatgacaaaaaatcctttcacttggcttcggtctgatgctttcgaagaaagagatctcacgtctattttgtcacattggaaacgcgtttttcatgcaccatttgcttttcagcagctgggcctacagacagctaaaacgtatatgctggaccggattgaaaaagacggaacattatacagctatgcgagcgcaaccatatatatggtttacagccttctgtcacttggtgtgtcacgctattctcctgttatcaggagggcgattaccggcattaaatcactggtgactaaatgcaacgggattccttatctggaaaactctacttcaactgtttgggatacagctctaatcagctatgcccttcaaaaaaatggtgtgaccgaaatggatggctctgttacaaaagcagccgactttttgctagaacgccagcataccaaaatagcagattggtctgtcaaaaatccaaattcagttcctggcggctgggggttttcaaacattaatacaaataaccctgactgtgacgacactgcagccgttttaaaggcgattccccgcaatcattctcctgcagcatgggagcgaggggtatcttggcttttatcgatgcaaaacaatgacggcggattttctgctttcgaaaaaaatgtgaaccatccactgatccgccttctgccgcttgaatccgccgaggacgctgcagttgacccttcaaccgccgacctcaccggacgtgtactgcactttttaggcgagaaagttggcttcacagaaaaacatcaacatattcgacgcgcagtgaagtggcttttcgaacatcaggaacaaaatgggtcttggtacggcagatggggtgtttgctacatttacggcacttgggctgctcttactggtatgcatgcatgcggggttgaccgaaagcatcccggtatacaaaaggctctgcgttggctcaaatccatacaaaatgatgacggaagctggggagaatcctgcaaaagcgccgaaatcaaaacatatgtaccgcttcatagaggaaccattgtacaaacggcctgggctttagacgctttgctcacatatgaaaattccgaacacccgtcagttgtgaaaggcttgcaataccttaccgacagcagttcgcatagcgccgatagcctcgcgtatccagcagggatcggattgccgaagcaattttatattcgctatcacagttatccatatgtattctctttgctggctgtcggaaagtatttagattctattgaaaaggagacagcaaatgaaacgtgaatcttatcaaacggaaatgttcaattggtgtgaagccctaaaagatcagattcaaaagcgaggtcagcttgaccagtttgaagatcaaatcgacaagatgattgaggctctggaagatgaccaaacaacagaagaagattggtataaacaggccgctgccctttatcgggatattacagaatcagatgatacaagtgaaagacgcgcttatgtccctatagggaaacacgtgctgccaaagcttccttacaaatactccgccttagaaccttatatttcacgcgatattatggtccttcatcatacaaaacatcatcaaagctatgtcgatggcctgaacaaagcagaatcagagcttaaaaaagcgagagcaacaaagaattatgacttaatcactcattgggaaagagagcttgcgttccatggagcaggccattatttgcacagtattttttggttttctatgcatccaaacggaaagcggcgtcctacaggagcattgttccaaatgatagacctttcatttggaagctattccgcttttaaagaacattttacccaagccgctaaaaaagtggaaggcgtcggctgggccattctggtctgggcacctcgatcaggacggctggagattttaacggcagaaaaacaccagctcttcagccaatgggatgtaattccccttttaccgcttgacgtatgggagcatgcctactatttgcaatataaaaatgaccgggccagctatgtagaccactggtggaatgtcgtggattggcgcgaggcagaaaaacgttttgagcaggcaaaagaagtcgtttggaagctctattaaaaaaagccccctttccccgggggcttcgtgttttaaaaaatccctaccacatgcaaaaacacgatgatgatggcaacaggagatagatatcgaatgagcagcagccaaaccgcaaaccactttcgtttgagattggaaccgcttttcagctcgtcaaacaaatcctgtttcggtatttttagcggtacaaaaatcgaaatcagtaacgcacctaacggcattaaaatattgctcacaagatagtcggccgcatcaaaaatagacagatgaaatatagagacgtcacttaagacaccgtatgacaatgcagacggcacaccgacaataaaaatagcaattccgcctaaccaagcgaatcgttttctcttattgacatcgcctttcgaaagtactgcgaccaaaatttccagcattgaaaaagcagatgtcaatgcagcaaataaaaatagaagtaaaaatgctaataaaaagataattccgaacggcatttgattaaacacagtcggcagcacgttaaataacagaaccgggccttggtctggtttgaggccgaatgaaaagacagctggaaaaatcgcaattccggccattacagcaacaagcatgttcataacagttacagatacagcggactgtaccagattttcctgtttctctaaataagcgctatacgttaccatgacagatacaccgacacttaataagaaaaaggattgtcccattgcatataaaatggtattggcatcaattgcagttaaatcaggcatcaggaaaaatttgattccttccatcgcgccatcaagtgtaaccgagcgcaccattaaaatgatgaataatagaaaaagcgccggcattaatacttggcttgctttttcaattccgctgcttaccccttttgcaacaactaaaattgttaccaccataaagagcagctggcctcctacagccaaataaggatttgaaatggtacttgcaaatatcgtatcaaaaccagatgtctgcgataaaccgccagtgaagccttttataatataaattaaaatccatccgccgacgacactgtagaaagatagaagaataaagcatgtcaccatgcctaaataaccgatccaatgccacttcgttcctggagcaagtgttttataggactgaacggcatctttctgtgttcttctgcctatgatgaattcacctaacaataaaggcagtccgattaaaaccgtaaataaaataaaaataagtaaaaatgcgcctcctccgctggttccggcgacatatgggaatttccatatcgcaccaagcccgatagctgatcctgccgcggctaaaataaagccgagcttcgaagaccattgatttgcttccttcaccgtatcactcctatttgatctaaccattataaaagttcattgtaagaatatcttcctatatagtcaagaacattttgattagtttacatcttatatctatatacatctgccaaaaactaatattgaattattcagaaaattatttataataagagaatgttatgaaatttgtaagaatttctgctgaagttcttgataagtgtgttaggagtgtttttatggacatcattagaaaaataagtcatttcgcaggacaaacctttggcatatgggtcattgtttttgcagtgctgggattttctttcccatctttatttacgtggatcagttcttatattacgatttttcttggcattatcatgtttgggatgggccttacactgcaagccgatgatttcaaagagctggtcagaaagccttggcaagttattattggagtaatagctcagtatacgatcatgccgctcgttgctttcggcctcgcatttgggcttcatcttccagctgaaatcgcagttggtgttattcttgtcggctgctgtcccgggggaactgcatctaatgttatgacattcttagcaaaaggaaatactgccctttctgttgcggttacgacaatttctaccttattggcacctgttgtaacaccgttgttgattatgctgtttgccaaagaatggcttcctgtctcgccggggtctttgtttatctcaattttacaggcggttttatttccgatcattgcaggtctgattgtcaaaatgtttttcagaaaacaagtggcaaaagccgtacatgcccttccgcttgtttctgtcattggcatcgttgcgattgtctcagctgtcgtcagcggcaatcgggaaaatctgcttcaatcggggttgctcattttttcagttgttatcctgcataacggtatcggttatttacttgggtttttttgtgcaaagcttttaaaaatggattacccgtctcaaaaagcgattgcaatcgaagtcggcatgcaaaactccgggcttggggctgcacttgccacggctcatttctcaccgctatcggccgtaccaagcgcaatattcagtgtgtggcataacctttcaggttctatgcttgcaacatattggtcaaaaaaagtgaaaaagaaacaagctggatccaaaagcagcaatctatcactttaaatatgcatcaaaaaaggtacatcactttatcgtgatgtacccttttttattatccttctaataaaagctgttcaggatcttccagtaaatttttgattgtcacgaggaagccaaccgcttctttaccgtctacaatccggtgatcataagataaagcgagatacatcatcggacggttttcgaaacgctcttcatcaattgctactgggcgcagctgaatcttatgcatgcccagtataccgacttgagggctgtttaagatcggagttgacatcagtgaaccgaaagtccctccattggtaatcgtgaaggaacctccctgaagctcgctaagggttaatttattgtttcttgcttttttcgcaagctcgccgatctctttttcgattcctgcaaatgtcaggcggtccgcatctcgtactaccggtacgacaaggccttcatcagcagcaacagcgataccgatatcatagaatttcttaacgatcaactcatcgccctgaatttccgcattcaacagcggatattttttcaatgcagccacgaccgctttcgtgaagaaagacataaagccgagcttcacttcgttttgctcaaagaattgatctttgcggcgttttctgagattcataacagccgtcatgtccacttcattaaatgtagtcagcatcgccgatgtttgctgcacctctacaaggcgttttgcaatcgtttgtctgcggcgtgacattttttgcacttcgacaggtttatcaaagctttgctgtgcttttggagcctgaggctgctgcttttgctgaggagccggttttgatgccggtttttcgtacgcttcgacatcctgcttgcgcactcttccaagcggatctccagttggaacttgagacaggtcaattcctttttctctcgccagcttacgggccgacggagaagcgatcgttcttgattttgcttcagattgtgcttcctcgctcacctcttgtgcagctggttcagcctgtttctcttctttcacgctttccttgctttctgctttctctgtaggagcaggggcagaactttcacccgcgccttctgaaatcgtaccgataatttctccgacctggacggtatcacccgaatctttcaatacctcttgaagtacacccgattcttctgctgtcaattcaacattcactttatccgtttctagttcaagcagatattcaccctgttctacatagtcaccaggctgctttaaccattgggctattgttccttctgagattgattctgctaattcaggtaccttaatttccgccattttttcatttcccccttagtttttgcgagtcaagctatcagatacaatacgttcctgttcttttttatgaactgtcggatctccctctgcagggctggatcgtcttcttcgtccaatatattgaacgcttactccctctggtgcaatctctgtcaaatacgggctgatataaccccaagcccccatgttctgcggctcttcctgcacccaaacgatttctttcaggttcggaagttttgcaaataactctttgactccttttgccgggaatggatacaactgttcaattctcgcaatgtgaagccactctttaccgtcttctaacttattaaaatgatcactgatgtctatagacactttaccgctggataatacaagtctggttactttttcatagtcatgagaaagtcccgactgttcataaacaggctggaagcggctttcgctgagctcctgcacttccgacaccgtatttgggttgcgaagaaggctcttcggcgtcataatgacgagcggtctgatttcttcacgaagcagcattttagcctgtcttcttaaaatatggaaatactgtgccgcgcttgtcaggttggcaaccgtccagttgttttctgctgcaagctgcaggaatcgctcgattcttccgcttgagtgctcaggcccctgtccctcgtagccgtgcggaagcagcatgactaatccggatttttggccccatttcgcgcgtccggcagaaataaattggtcaaaatacacttgagcagcgttggcaaaatctccgtactgcgcttcccacaaaacaagcgtttccggtgaatgcacgttatagccgtattcaaaaccgagaaccgatccttcagacagagggctgttatgaacagcaaatgatgtgctgcagtcagataagtgatgaagcggcacaaattcttcgcccgtctcactgtcatgaagcacaaggtttctttgggcgaacgttccgcgctcggaatcctgtcctgttaaacgaatcggtgttccgtctttcaaaattgaagcaaacgcgagtgattctgccaaagaccattccacttttctgtcatcatcgaacgccttggcgcgtctttctaaaatgcgctttagcttgccgaaaacattaaatgactccggccagttgatcaattcgccattcagcttgcggagcacatcaaaatcaatcgaagtgtccacatctgggaaaccgtttgatacaggctctggaagttcaatttcacaggcagtgtgttcctttttagacggaactttctgatatgcatcttcaatgcgcttcgttaccgatttttcgatgttttgaacgacttcctcggtaagtacgccttcttttaccagcttttcagcgaaaatttgtttgacggtcggatgctttctgacagcatcatacaacattggctgagtggttgacggttcatccatttcgttgtgtccatagcgtctgtacccgatcaaatcaatcagaaaatccttgttgaatgtttttcggtattcgaccgcaaacttaacagctgaaagacaagcttcaggatcgtccgcattcacgtgaacaatcggaatttcataacccttggccaggtcgctggcatattttgtcgatctggattcagcgctttctgttgtaaatccgatcatgttattggcgataatatgaatcgcaccgcctacttgatacccttttaaagaacttaaattcaatgtttcagctacaattccttccccagggaatgcagcgtctccatggattaaaatggccagcgattttgtttcatcttgtaccgggtatccgctttgtgttcgcgtttcctgtgccgctcttgtgctgccttcaacaatcggattgataaattccaagtggctcgggttgttcgctaacgtaatgcgcgctgattttgtttcagcgtcttgaagctcccgattcgcccccaaatggtatttgacatcccctgtccatccgtagctgattccaattgatccctcagacgggacaagatctttattcggcgcatgctggaattcagagaagatgatttcatacggtttgccgagcacatgtgccaagacattcaggcgtcccctgtgcgccatcccgatgttgacacttgtcgtgcctgatttgacagattgtgcaataatgtcatcaagcactggaacaagagcgtccagaccctcaatggaaaagcgcttctgcccgacgaatgtgcggtgcaaaaactgctcgaagccctctacttcagtcagtctttccagcacagccgacagcttttcagctgagttcttctggaacagctcgccagattcaatctttcttgtcagccactcgcgctctttgaagtcatgcacatggtcaaattcaaaagagatggttcttttatacgtatttcgtaaatactgaatggcttctaaaccgttcgtaatgtttttaggagcgtctttgcagatgacagacgcaggtattgcttttatttcctcttctgttagcccgtaatcggataatggaaaaagttcgctctttttctcatcctttctgagcggattgacggaagcgttcaaatggccataggttcgaatatcttctgcaagtctgactgcggatgcgatcttttgaatcagatcggctgtaacacgtcccttttcttttgttcccgaggcctcttttatatcgcttggcggagcaccgagctcgtcgaacatttccttcaaatccgggtcaatgctgttcggatcctgggtatactgatcgtaaagctccagcgcatagccgaggttcggaccgtaaaaatcttcccaattcattcgttgtttcatactattttgaaacatttgaatattacccccaacttaaataatcaagtgatcgattcactatcttgaaataactttcgaacgctgtgtccaaaattatgtaataaaaacgcttccaacgatattttaccactgtttgcaatttgattctaccttgattgttcacaaaatagtaaaaaacctttataaaaaacaaaaaatttaatcattcgaaaaaacaaacgccaaaaagcataggattaagggctatcctatgcttttatgaagcagttttttcagcagcggatacaaaacatccggtagctgatcaacatccgggacaaatatactgaattttccgtacatatcctgaatcgtcttcatttgcgattcttctatttctgagttggagagaaaaacatttatcacttctattcctctttttcgggcttcgataaccgcctcacttgtatcgacgatcccattttgttcgtagccaaatgcggccggctctccatctgagaaaacaattaagaacttttgcgcctcgctgcgatgcagcatttttttcgtcatctgcctaattgcgtacccgtcacggttatcttcttctggctcaagctgcataatggccggtccagaatcttgtcttaatgatgattggaagggaataaccgtattgaaatagtttggttggcttgtttcggttgcatcatttgtgtcctcccagaaaccgacaatctgatgcggaaccgctaccgatttcaacgcttcgtgaaacagcacgattcctcgttttgtttcgtccattttgtcgaacatgctggcggaacaatcgaccagcaatgtaaaaactgcgtcgatttctgtagacggttcttgctttttgtagaacaggcgcggatttcgctcagtgaagtaacgaagaagcttattattcagtctcccggcatgaagatctgttctcggcaatgtttttttatgctccagcgttttttgaatcatttgtttcaaacgcttttgatacgattcaatcgtttttgcctgctgtttataagaaagctcctcttcactagttgccggctgcggttctttataaattggaaatgcatatttattttctttgccgtcagccatacccgctccgttcggctggtctttttgagactccagcgcttccagcttggaatagtctttccgtttcgtatgtctggctgatccttgaacagagccaagggcctgatctccatcgtcgccttcccttgaagcatcttttcctaaatctgattttgcgccgtgttcaatatcaaattgaaggaagcttttagacggtgcttctgtttcccggtgccatgtcggcatttcttcttcatggatatcctcatcaccgtctgatttttttggaagcgtgatgtcatcactcagcttcggcgcttttttctcttcttcaaataacggctgttctgcagcttttgcgtagtcaagctcaggcaaaaagaagtaggtgttcaacatgtctttatcgagcacctcttcaagtccgtccatgaggtcctcaacaattttcagaacctgccgtgtcgaatctacttcatacacacgcaagagctgctgctcaataaacgggcgcatcagatcgatatcttcacgcatggatggaagggtctcgagcggcgattccgctgtgagcttgacatagatcgcgcaaaagagcgcatcggtaaaaatgcttcgttccaaatttaaggtcagctgggttgagaaatgttttctgtacatgtcttttcgcttcgcaaatacatgtttcgtacccggacgctcacgtttgatgcattcttcgatcctaatgtcttcaagcagcataaagagctgcttggcaaaacttttaaaggtgagatgacgatggatatcattcaaaaagttcgcaaactcatgcagcgagctatatcttgttccgactgaacgcaggtagacgtcgcttttcagacccgcttccatgtcctcagctgccctgtctttccaaaagtggctcatatagattttcttttcaaatggattgtaataggactgaacgccatactccacttctaccgcttcactcttggtgagtgttttggccaaatcagtcagcatcataaataaaaatgaatcaatcgtgctgtcgttaaatttgataaatttcatcgcagccccctcattcaaacagagtttctgcaatatttcggacggccgctttttcccgatcatcatcaagcttttctacaattccccgctcaatggcacgacgcggcggaatataagcagctaaatcacatgtatcgattaaagctctgatggatgccgcttcttcagacacctgtccgttattggcctgaacgatcaagtcagaggaaagcgtgataaatctgtcaatcaatttctcgtctttcaaggctgactgagacatgagcacttgtttcagcagctcgcctttaatataaggcacatcaatgatgacaaaacggtttttcaacgcttcattcagaggaacagttccgacatagccttcattgatggctgcaatgactccgaaaccgcttttagcccgtatgacctcgcctgtaaacggatttgtcatcatttttctgtaatctaatacaccgtttaaaataggcagtgtttccggcttcgccatattgatttcatctatataaagaaaatggccttccttcattgcctttgtaacaggtcctgaaacaaactcgattgtcgcctggccagattgattttcaatcgttttataaccgaccaatgcctcagcatccaagtcgactgaacagttgacgctgtgcatcggtttatgaaaatagctggacaatgtttctgccaactttgtttttcctgaacctgtaggccctttcagcaggacattttttcccatggctaatgcaataatggcgtcaaatagaatggcttcatcctccgcctcatagcctgatgttcctataagcgattgaaactccggggaaataggctgctctttatatgataaaagcttttgttgtatatcttccggcaatgttaagtgctgtagttgtgttgtcatagacagattccctttcctattcatattccttaacgagtatactaaaaaagcccctgtatgctcaatacaaaagggcttggatgatattactgcttctcgttatttcccaaaagggctccgcagacaatacgcgcaccggaattgccgcttgggtttgtcagataatcgtccgcttgttcatgaataataaatgcacttccgtcctcgtcgagaatatttagtttacttccttttttcagtgaagtgtcaggcgcattcattatgacatctacctttccatcagcaccgacttcaaggttcggcagatctccggcatgatgccccatcggattattgaagccgtgttctttgttcagtggattaaagggaccgcccgctgattcaaaatccggcctgacacaagaacctttctcataaatatgaaaaccgagagaagcacctggacgcaggctgtttgcggaaatatgaatatcgaggccttcatcatctgattctttgatctctataaagccgactgctttcccttcacgattgaccaactggacatgatgaccaaacgctgacgtttcaaccacttttttttccggcacccggttaggagggtctggaggttttttttgtccgcatccggcaactcccagtgccgtcagcatcatcaacagcaagagacggtacatactgtctcccccttgttttttctaacagtgtggtcaatcattgtctggtataaacaaaaaagcctataaaaggctttttgtcatactcatttttaaaaataacttcttgcgcccaagtaccgctgtttccaatacgaattgctgagattggaaatgtcgacgcccgatgagcttgcatgaataaaatcaccgccgcctagataaatccccatgtgagacgggccggatttatatgtggtaaagaagacaaagtctcctactgacggctggctgactttctgcatgacattccaataccctgccgtactcaatcttgatatagatgatacattattaatgaggtaataaatgaagccgctgcaatcaaaaccggcaggcgtgtttccgccccatcggtaaggcactccgacatattttttcgcttccgttatcattctgtcaatcttcgagcctatttgaatgtttgaccctgagttatcttttggctttgttggctttgtcggatttgaaggattagattttgatgctcccgaaatagtcagaacctgcccgatttgcaacacatccgatgataaattgtttttatcacggatgctttggacagtgactccgagccgatttgcaattttccacagcgaatcgcctgcttttaccttgtacgtcgttgtttttgagggattggagtttgacggcttttttgaaccgctgtttccgctcttcggtgagctgcttccttttattttgagcacctgtttagggtaaagtgtatctgatgttaagccatttaaggtttttaattcagctacagtcatatttaagctgtttgcgattttccacagtgagtcaccaagcttgaccgtatatgtactttttgaagaacctgaagaattggaaccgctgtttttctttgatccatttgatccgcttgaactgcttgtccctttgatcttaagcttttgccccggacgaatcaggtcactgctcaggctgtttaagcttttaagctcagaaacactcattttatgatttttagcaatcatccatagggaatcaccatatgcaactgtgtatgttgatgttttgcttgaattagatggggatgtcgtgctttttttgctgctttcaggaaccttaagactttgtccgacataaagcaccgttgatttcaatttgttttcggatttcagagctgatattgtcgtatcatactggcgggaaagtttccaaagagagtcaccgctttttacttttatcgtttttgcttccgcgggtgctgcggccatcgacgacccaacaactgcagaaacagccaagccggctacaatcttctttttcattcattcaacctcctaaactgttttttgcaaaaacagctagtattttgtttccaaaaatggcacgcaactgttttatcgtcaatttttcagcaagttaaacccttttcaaacatttggcagcattttcagcatcgttcgacctttaaaccttcaaataaacatctaacattttacataagcacgatatgtttttcgaaagtctaaggaactatttaagcgagggtaaaaatgatggttttctattgatgaacgaagcagtttctcctcctttcttgtctatttttctaatcaattctctatcggcgtgtcaaatccctcttatgaaatggcaaaaagcctgttctttcgataagaacaggcttttacactatgcatttgctgattgagttttttgttttacagcttcaagaatgctatcggccgcttttttagagccgcctgccgctttcagtgattgtccaatttcttttgccttttcagcatacgaaccattattcattacatcttgtatcgtctctttcagaaggctttcagataattcttctttttttaacacttttcctgcgccgactttttccacctgatctgcgacaacaaattggtcgcctcccatcggaatgacaacgagcggggtttcaaaatacaaaccttcacttgtgctgttcattccgccgtgtgtcacaaataagctggctcttttcaagatctcaagctgagggacatacgggcgtacaatgaaattctccggaatgtcgtttaactcacttgttttaatatgcttgccgatggaaagcacaactttaccgtcaaagtccttacacacttcaaggcattgattaaaaaactgcttttgattattaaaaatggttcccattgaaataaacagcacgttttcattgtcaatctgatcaaatgggaaatcattgtttccggctctttctgtaatggaaggaccgacaaatacatatcgctcgccaaattgctcagccagtggctgaaatccccttgatgtaaagacgattgtcaagtcaccatcagctaaaaaaacatcaaatggcttcttgatctctgcttgaaaatcagcatttaacgtttctgcaagctgctggtatgattcataatgaggcgaatcttcaagtgatcctttcatgtacgctcccatcatttccttcgcaaattcctcattcatcgcaaaggttgtacacaatgaaaatcttggcagcttcagcatgttggcaatgactttacccgcgagaagatggtgatcatatatgacataatcatacgattcatgtttgacttcctcataaatatgagtcgcgatatccttacaggctttcaaaaaagcgcagagcatttctgtgaaatctctttcttcatcgccggttgcgtttttcccgaagtaatctcctctgaaatcatgatactcacgaaactctatatcaagagctgtgattttttctttatattccttcactgcgtagtacgtaatgttttctccccgggatttcagctccttcatcacaccgatagagggattaatatgcccttcaccgggaaaaccgatcattaatacattagccatgcgacagcacccttcctttgaaaatttatgtaatattttatacggtactataaatacataaacaggtaaagtatttcacttaattaatattcattacatataacttttctaccagtttatatttcctgtcttcaagacaaaaagcattcagcttgaagcgaatgctttaataaagatacgaattcagtcattttgtctcatgataggattcttaatcaggccctttttattatttttacgttcttggtgaaattaacggatataatacaccgtctttggcaaacgacatcttccctgtttcctctgaaaccacgagcaccagtgcatccgtatagcccgacataccgagagccgcccggtgccgggttcccaaatggatatccacttccttcgtcgtcagcgggagcacattggctgctgacacgagtttgttttccctcactaacaaagcgccgtcatgaagagggtttccggggaaaaagatgctttcaattaatgaagagctgatctcggcgtgtagggaggtgcctttttgaataaaatgttcaaccgggtccgctctttcaatcacaattaaagctccatgcttatgttccgataaggctttaatcgccttggccagctcaataaatgccggcgtaaattcctcaatgtatgattgcaaataaaaggaggatgcaatcccctgcatgtcctgaaatatgtgccccaaatcatctaattcacaaaggagacactggtctttttcgtgaagcgttttcaagattagagatgcatcacctaatatttgctctaggtacacctgtattttccccttgaacgcattttctgatatctgctcatagcgcataatcttcatctcctgttcaaatttccaacttttcacgaatgcttatcttattgatgcacattctattggtaaaggagggatgtaaagaatggaaatcgaaagaatcattcagtatatttgcacctttttaggcgtgatttcgctttcttttatttatgcccaaatgtttagaaaaacgaaaccgacaaaaaaagaataggcccggcgttcattgctttttatacataaaatgttataatttctctcgttatgaaaaagaaacggagatcaatgtatgaaagaaactcaaaacgcccgggaaaaaatcaaacagctcttgcacattttaataccgatattcattacccaggcggggctttctcttatgacttttctagatacggtgatgtcagggaaagtcagccccgctgatttagcgggtgtcgcaattggctcaagcctttggacccctgtttacacaggacttgcaggtatattaatggcggtcaccccgattgtcgctcagttattaggcgcagagaaaaaacagaagattccctttactgttttacaggctgtatacgtggccgcgctacttagcatcgccgttttattgattggatatgctgcagttgaccttattcttggccgattgaaccttgatattcacgtgcatcagattgctaaacactttttaggctttttatcactgggaattttccctttatttgtttacaccgtgttgagatcattcatcgactcattaggaaaaacgagagtcaccatgatgattacactcagttctcttccgatcaattttgtattgaattatgtatttatcttcgggaagttcggaatgccggcacttgggggtgtcggcgcggggctggcatccgctttaacttattggtgtatctgcatcatcagttttttcattattcataaaaacgcaccgttttctgaatacgggattttccttaccttgtataagttctcttggaaagcatgcaaaaatttgctcaaaatcgggctgcctattgggttcgccgtgttttttgaaacgagcattttcgcagctgtcacgcttctcatgagccattttcatacagtgaccatcgcgtcccaccaggcagccatgaattttgcgtctcttttatatatgctgccgcttagcgtgtccatggctctaacaattgttgtcggatttgaagcgggtgcagcccgttttaaggatgcacgctcatatagcttaattggcatcatgatggcgatcggcttttctttgttcactgccgcctgtatccttttattcagagagcaaattgcgggcatgtacacttctgaccccgatgtgctccggctgacacagcactttttaatttatgcgctattttttcagctttccgatgctgttgccgcaccgatccagggagcactcagagggtacaaagatgtgaactatacgcttgcggccgcttttgtctcttactgggtcattggccttccggtcggttttatggtcggtacgtttacaagcctcggtgcattcggctattggattggattaatagcgggactcgccgccggagcagttgggctgtttttcaggctggcaaaactgcaaaaacgttattcgcaaaaacaacacatttaaaagaggtgatcaatcatggcaaaaaacaaaaaattattcgagtatctttcccagcatgcggaaaccatcagttcaacatggtatgaaacaatcgaggagactgatcccaattccatttatgcctcaacagatcctgttgtcattcacaatttaaagagccagaatcttgcctttaactataaaataaaccgtatttttatagatgatgaggacgtatacttgcctatactgaaagaatgggcctttgaagtcacacaggatcaagagcatttaaaaactcctatccactatattattcgggagtttgtcagagtgagagatttatatgtttcctatgtgaaagaatttgtccatctcaatcaggatactgtgaaaagcgaagaagccgaagacctgtatcacgcccttataaaagcgtttgatcttgtgattcatatttttatagaagaaatgtacaaaaacacaagccttcagcttcaggcccaaaaagatatgattactgaattgagcgctccggtcattgtgctgtttcacagcgtcggactgctgcctttaatcggagatattgatacagtccgcgccaagctgattatggaaaacacactgcatcaatgtgcgaaaaaaaaggtgacacaactgtatattgatttgtcaggagtagctgtgattgatacgatggttgcccatcagctgttcagtctgattgaggcgcttcgtttaatcggtgtttcttcaactttgtctggaatccgtccggaaatcgcgcaaacagcggttcagctaggtttgtctttcgaaggtatttccttgagatccactctcgcttcagcaattgcatcggacttaaaattaaaaaaggtataaggcttaaggccttatacctttttgattaatcattccattgatacgtccaatatatttcttcttcaaaccatgttgccataacaggttcattatttttcaatttctcttcaagctctctgagcatgccttctgtttgtgtgcggtgagctcttaacgcattcattttaatatcagctacttctttgatatcaagtacgacatcagcttcgccgagaacctcttctctgttgcgggtaatggccatgcagattgtacgcggacggtcttctttctttttgcggtacaatgcacggataaccgcttccccgcatgcatcatggtcagggtgcacaccgtgtccgggataaaatgtgacaattaaacttggttttacatcatctatgatctcttccatgatatcagctaaatactcatcatcttcaaattcgagcgttttgtcacggagtccaagcatacgaaggtcattgatatccatttctttgcaagcgttgatgagctcttgttttcttagcagcggcaacgtttcacgattcgcgaaaaatggatcgcccatatttctgcccatttcacctaaagtggcgcaggcatacgtaacgggaatgtctttttttctgtttaaggcaatgaggcctgccactccatatgattcgtcatcagggtgaggcaggattactaatacgtgttctttcattatttttcacccttttctttaaactgtgaacggtttttcactgatttgcagagaaatagccagtttaccgcccggcagatgtcccgccattaataaacggttttcttcatctaccgtgtattcagtcaagccttcagcataaatccagccttcttctgttttcaagccaacgcggtaaggcccgttgcctttgatttttgcctgatgataagtgacttttgcattgcggatatacgcaacaaccgtcatgttcttttcatttaagtgcgctgaataagaacctgtggtggtttctaaatggatatatacagggcggtccgcatatcgttctaaagatgcttgcacatcttcttttatgatcgctttcatgattgctcccctctttcttcttttaaatactctgcacgttctgtatgtaatttgaccagctgatatttcacagccggttcgagctgtgaattcacaatgcgctgaatcgcggcaaaatatttttccagcatcggttttcggagtcttggatgtgttcgtttatccaagagctcaagatcaatcgcctctgctaccgcttctgcgtcatcatgtgcgagagatcggttattccaaagtgaagcatatgctttcactatctctttatcattgtccatcgtcttgctcctttatgtcttacatacatgaaatgattatacataatatatgcatcagctgaaaagccaaaggcctcaatggctttttgacgcccgtttccacttcacttgtgaaaacgtaaacaagatcagcgcagcccatatacagctgaatgtaaaagccttcgagctggaaaatggctcattgtaaacaaacagcccgatcagaagggtaatggtcggcgcaatatattgtaagataccgacttgatacagtggcagccgtttcgctccttccgcaaacaataagagcggcaaagccgtaaacacaccggccaaaaagagaagcagccacgtccctccgctttctgcacccgctggctgaacatgtccgctgaacagcaaataccccaatgcaatgggcataatcatgaatgtttccagcgttaaaccgatggcgctcggcaggcttgttctttttttgcttaacccgtacagcccaaagctgaatgcgagcagaagcgcaacataaggaatggagccgtattggaacgccgagatgatgacaccggctgccgcaatcgaaacggccactaattgcaggcgattcagtttttcctttaaaaataaaatcccaaggagcactgatacaagcggattaatgtaatagccaagactagcctcaagcaaaaagccatggttgacagcccatatgtatacaaaccagttgatcgaaatcaggatagaagcaagaaataaagagaggatccctccgttctttttcagagagcgcagctcctgccatcctattttccattgccgcaagaaaaaaagtacgatacacataaaaacaaaagaccatataatacgatgagacaaaatatcaagagccggcagctgttcgagaagcttccaatagagcggaaacaggccccacatgataaaggaaacggctgtgtaaataacgcctttttttgtttctgaatattgcatttatatccctgcctttctttagagcatcttatattatatcacgtgaaagatctggcgggcatatactattttgtccgtgaagaaaggatgtgaagacaatgtttgagtggaacaagtactttcctttccacaatcaattttctaaagaagcattaaaaaaagctgatccgaaagaagttgaaacgtatgtcaatcgtgtgatggaaagtgtgttcggcagtgattatgcggctcaatttcctttccgcgatcctcttccccaaaaagaacagcccgccaaacctgatgcaaaacctgatattgatatattcgaaacagcagaccatgtgtttgtaaaggtgccaatcagcgaagaatggctggaacaagtgagaatcaaacacacatctcacgaattatggttggaaaacttcccaagagcagatcatccgaaaaaagtaaaccttccttgtttagtcaaacgcaaaggaacaaaagccgtctataaggatggccttctggaagtcatgtttcaaaagcagcaagactacaatatgtccgaggtagaaatcatccgataaaaaacggcctgcaatcgatgcaggccgttttttattaatagaaaccgggatatcccccgtatggcacgccggcaccaaaaccgtacggtccgcctccatatccataagggccaggaggataggcatagggacgagaatagttaaacagcgcactcccgagaaaaccgcctaataaaccgccgactagaggagcgccaaacaaaaaaggactacgcgccggatatccggctggacctgggattccgcgtaaatacgaatgatgagggtacatgaatttttcctcctttatgtctgcctatacgtaaagtattcagcaaggaagaaaaacgattgggctacggactgtctatgattgttacatcacaagccctgccaataacacacagccgagccctgtaaccgaaagaactgttgtaagcagcgtccaggtttgaaatgtttctttcatactcaagccgaaaaattcctttaccatccaaaatcctgcatcatttacatgacacgcaatgacactgccggctcctgttgcaagcaccattaacgcggggtttacactgccagcctctataagcggagctgccattcccgctgtggtaagcgcagccacggtagcagagcctagacacagacgcaaaaccgcggcgatggtccatgcaacgaatagcggcgacatgtttgtttgacggaaaaaatcagcgacataatcgccgaccccgccgtcaatcagcacctgtttaaacgctcctccccctcctatgatgagcagcatcatcgcaatttgcgaaattgattctgaaatagatctgctgatttcctgcatagatattttacgggcatatcccatcgtatagagtgcaagcaacagcgaaatgagcattgccgttcccggagtgccgataaattctataatgtcttttccttttgaatgttcactcaataataaagaaaaaactgttgccattgccataaagataaccgggaataaagacgtgacagcactgatcgcaaagcccggtgtttcattcagctgaaattctttccttggtcctaaccccgataggtttccatgcttttgatacgcaccaggaaaccgtttcatcgcaaatttattaaataaaggcccggcaatcacagttgtcggaacagcgatgatgattccaaaaagcagcacctagccaatatgggcaccatatgcaactgagatagcagttggagcaggatgtgggggcaaaaatccgtgagtaacatttaaggcggcggccatcgggattcccagatacagaaaagacatttttaattctttagcaatcgcgtaaacaatcggtatcaacagaacaagacccacttcaaaaaacagcgcaataccgatgataaaagaggcaaccacaaccgccgcctgtattcgtttcctcccgaatttgccaatcagcgtaatggcaatccgatagccgcccccagcatctgagacaagcctcccaagcatcgcgccaagtccaaacactaaagctaaatgccccagctgcccgccaattccagcctcaattgaaagaacaattttattgatatccattccaagtccgatctctactaaaaatgaaacgacaatcagtgagacaaaggtatttaattttactttaataatgagaaataacagaatcagcactccgacagctacaattaaaatcggcatggtacccctccaaaagtgttttatatgattctcgcgacaatgttttggcgtttttcatgcctagacgaacagaaaacgctttcattaataactaaaaacgtcttggttatatgattgttatcttttgatcaactaatatgttcatactaatctcctaatcaatgactgtcatcgtttttatgagcttgtctcgattacctaccgcctaacccaatgatttattagttatatgttgattaacttttggttatatgttatgttttttaaagttgactgccaatcattatatctattcattgtctggaagcaaatgagacaatatgagaacagacggataacaacttcacagaaggaggagtacacatgccattattgcgttttgatgtaattgagggccgtgatgaaaaatcgctgcaattgttattagatactgctcaccaagcgatggttgaagcatttggtgttccggaaagagaccgttatcaaattgtccatcagcatcccgcaaacgagcttataatccaagatacgggattagggtttcagagaaccaaggatctggtcatcattagtatgacaagcaaagcaagaaccgaaagccaaaaggaaaaattgtatgctctgcttgctgaaaggctagaagaaaaatgcggaatttcccctgaagacctcatggtatctattactgagaatggtgacgcagactggagtttcggtcttggtgaggcgcaatttttgaatggaaaactataaaatttcgtctccccacaaaaaaaagaagagagagctccaagaagctctctctttttttcataaatgcggaagtcatcagtatagaagcatccagcaatacgaaaaacctggatctccttattagatccggtttaaacgccaattggatgctgactgggttttggccgaaaatataaaattttgctgatttgcataataagataactcataatccccatttacaacaggttggatgctataacttattgatcatttccatgaacatgacacttttgccaatccggaaatgtcagtctgacaaatataaaaagtcatgtaaacggggtgtgaaccgtacttacatgactcaccatggaaacaaaggctctttttcagacgccgctttccttatttctcttcttcacacactgtgtcaccaggctcgcaaaattgatcggcccatgcctgcatctcttgaaatacagcttgaagcgctgttcctttttcagtcagcgtgtagatgactttgaccggcgtttcagggagaacctgccgttcgacaatctcgttttgttcaagctccttcaagcgctctgccaacattttttggctgatcatcggtattgtttccgttatctctttaaaccgtttcggcccatccattagcacatggatgatcagaccgttccatcgttttcccagcaatgagaatgcggattccattttagggcacatcgtatttcccacaagtcttcatcccttcatctattgattgacatgtattcaatgatccattacaataatctttcaagttacatttagtaagcttctaacttttctattatcataccacgtttatccgaaggaggaaacactatgacgaatactctggatgttttaaaagcacgtgcatctgtaaaggaatatgatacaaatgccccgatctctaaggaggagctgactgagctattagaccttgccactaaagcgccttccgcttggaaccttcagcattggcattttacagtattccacagcgatgaatcaaaagcggagcttcttcctgtagcgtataatcaaaaacaaatcgttgagtcttctgctgttgttgccattttaggcgatttaaaggcaaatgaaaacggtgaagaagtttatgctgaattagcaagccaaggctatattacggatgaaatcaaacaaacattgcttggccaaatcaacggtgcttaccaaagcgagcaattcgcacgtgattctgctttcttaaatgcttctttagctgctatgcagcttatgattgccgcaaaagcaaaaggttatgacacttgcgcaatcggcggatttaacaaagagcagttccaaaagcaatttgatatcagtgagcgctatgttccggttatgcttatttcaatcggcaaagcagtgaagcctgcgcatcaaagcaaccgtctgccgctttcaaaagtatcaacttggctgtaaggatatgaaaaaccttagtccgaaatccggactaaggtttttttatacaatcgcctctttgtaccattcacgagcctgttcagcttcatgctgagtcagctgatggcccccgtcctgccagtaaacggaggctgatgccccgctgtcacgcaaatagcggtaaagctcttctgattcttccttcgtgcaaagaggatcgtatttcccggcaccgataaaaacagggagccccgccatatcaggcagctcgataccccgaatcggaaccattggatgatgcagaatagccccttttaacacatctttataatgaaaaagcaggcttgccgcaatgtttgcgccgtttgaataaccgactgcaatcactcggccgcgattaaactgatgcgtttctgcagcctcgtcgataaaatctttcaattctcttgtccgcaccacaagatccttttcatcaaaaactccttcactcagacgtttgaaaaatcgcggcattccattttcaagcaccgatcctctgacaccaagcaaatgggcatcagggtctataaaccgccccaatgaaagcagatcgtgttcattaccgcccgtgccatgcaacagcaaaagtacgttgtcagatgttcctttttcataaatatgcttcattataaattcccccttttaaagttcaggtaaaatgtctgtaatttgttgtctatgtttctccagccattcaggcagttttaaggaagtccctagctcagcaaacgtttcatctgtcataaagcccggttcatctgtggcaatttcaaataagataccgcctttctccctgaaataaactgatgtaaagtattccctgtcgagaatttctgacgcaggcagatggttttcagcaataatcggcagccatttcgcctgttcctttttcttagtccgaaacgctacatggtgtaccgtaccatatcctccgactcctcttttttcaggatgtaaatggacatcaatgacaccgccgacggccgctgaggatgccagtctgacaatctggtcttcttcggccactttggtgtatccaaagctttccgttaacaattgtatggtcgcctgcgggtcgtaagaatatagcagcacacctttcattcccgtaattgcttcatttgttgtgatcccgtcaggcgtccactcgcttttgccgcttttcgcatcctccatgatcgccagcggaaggtcttctgtatcgtcaaaaataagacctttttcaccaaacaacgttttttcctctaggctcagcccgcttttctcaagacgctccttccaaaaagacagggagcctgagggaactgaaaagtacacccggcccgcttggccttttcctaccgttccctgtccgcttccttggaacggaaaaaaggtcattattgtaccgggatctccgttttgattcccaaagtaaaaatgatacgtcccgggatcatcaaagtttactgtttttttaacaagtctgagcccaagcacttctgtataaaatcgcaagttttcttgcggatctctggcgaatgctgtgacatggtgcaatccttctgttttcattttctcactcctatttatctcgatttcaagatatttattattttaaacctttattgaaaaggatgcaaaccatgtgttttgtttaaataactgaaaaaatcatttttttctaataattatcttgtgatcttttcttacaactgctattatagtgagcattatcatgtttcaggaggaaagtaaatggttaaaaaagcacttattgttattctcattcttttgccattcgttcagctcgcgcttttgccgcttgtgaatcgaatagaaccgattatgttcggcctgccgtttttccacttttggctgctgctgtggattattgttacgccgttatgctcgtttggcatttatcagatgcaaaaaaaagatggaggacttgaataatgcaagggaatctgactgcacttctcattactgctattattgttttaaccgttgtctgtatcggctttctcgccggaagagacaaatcctcacgtacttctgtggaagaatggtctgtcggcggcagacgcttcggcggtcttctcgtctggtttttagtaggcgctgacctttatacggcctatactttcttagggttgaccagtactgcttttacaggcggaagtgttgcatttttcgccattccttattctgtgttggcctactttatcgcctacttcttctcgccaaaactttggaaagttgcgaaaattcataaattaacaacactcgcggattatgcccgggaacgttttaacagtaagcttttggcaagcctcgttgccatcgttggggtactcatgcttattccgtacatatgccttcagctgagcggcattcaagacacgcttcaggttgccggcactggctatattaacgtaaaattcgttgtgatcatttcatttattcttgttgctctttacacattcttcagcgggattaaagggcccacatatacagccatcattaaggacattttagtatgggtcattatgctgtttatggtggtgtccctccctctcattcattttaacggctggacgccaatgattgacacgttagtgaaggaagcgccgcaaatgctgacgataccggcagaagggccaaaaggcatcccttggtttatcacagcatctattgtttccgctctggcactttttatgtgggcacacgccgctacaggagtttttacagcgaaaagcgctgatgcagttagaaaaaacagcatgtttttgccgctttacaatattgtgttaattttggtcatttttcttggctttatcgcctttcttgttctgccggaagatacaaatccaagactcgcgctgctgcatttgattcaaacatcttacggcggcgtggcacaaggttttgcatatgccactatcgctcttgcttcattaataccttgttccattatggcaatcggcgcatcgaatttattcgccaacaacctataccgggatttgattcatccgaatgtgtcgcaaagcaagctgactcttgtcacacgttcaatggtgtttgttgtcatcggtctcgcgctgctgtttggaatgctgtttccgactgccttagtgacacttcagctattaggtgtatccggtatggtgcaaatcttccctgcgattgctgtcagcctgttctggaagcgtcaaacaaaagaagcgacagttatcggattattagtcggccttgcggttacgtttattgtgtataccactcaatccgcacatggcatttatgaaggattctggggattggccgccaacatgatcgctgtggtgatcctgaatccgctgttcgttaaaaacgcgggatccaatcctgtcattgaaggtttatttggcaaaaaacaagacgctaatccaaatcaaaagggtgcataaaaaaaccatacgcggcagccgcgtatggtttttttacatttcttttttcagtgtttcaattgccttttccatttgcgtatcattatcagacagcttcttttgaagttctatcattaatttcgttgttgtatcgccagtcagtatgcctgtctctttcagcttctcttttttctggaactgtttgacgacagatacaaagtcctggtcatacgtactgttaacctttaccttgtaaccaagtgctttgagcattttctgagccactttgacgtttgtgcctgtatcacctgatttgtacgttttatctgcgtccaaatacggcagcttcgcgtaatcaggcagctcagctttcacttgaggcttgatgccttttttgtgaatccattcgccgtcagcagtcagccatttggcaactgtcagtttgacagtagagccatcatcatattcttttgccgtttgcactgtacctttgccgaatgtcgtctcgccgattaacggtacgtttgacgattcatgaagggcagcggccataatttcggctgcgcttgctgtaccgtcatttactaaaacgacggtcggcttggtcactttccgttctttttcggccttcatgacttcttttgaaccgtttttgtattcaacctgcatgatgtttttccctttatcaatgaacaggttgctcatcgtaatcgcctgttccattaagccgcccgggttgcctctcaagtctaaaatatagcctttggcgccttttttctctaaactgtcaatcgcatctgtcagctctttagctgttgtttcagagaaagaagtgatttgaatttctccgatgttgttgtctttcatctctgaatagacagtctctacaggaatggtatcgcgcttaatggaaagatcgatattccccactcccgctctgttcagttcaagcttcacctttgtgccctttttgcctcggattaaagcgacggcttcatttacattcatgccttttacgctttttccatttaccttaatgatttggtccctcggtttgataccggctttttcagcaggtgaacctttaattggggatacaataaggatttctccgtctttctcctctacttgggctccgattccttcaaaagatgctgaaatcgtctcgtcgaatgatttcgcttgctcttgatccatatatgtagaatacggatcatccagtgattgaatcattcctttaattgctccgtctactaatttgtcatcatctgttttttggtaataatcacttttgatttgctcatacgctttatttaatttgtcgaacttgctgtctcctgtgcttgctgatttttggcccaggatactggaattgcccgtaataaataaagtaagcgccgaagcgacaactgcagtgatcagcacaataaaaaacagttttaattgccgtttcaattaaacaccacctttttcttcttacattattatcatggacgaattcttattcgtcaactcggagcagaaatgaaagagaaacgcccttcttttgcttttcataaacctatgtctttatacgacatatgataaggaaaaaggaggattcgatattgagccgatatttagaaatgctgtccttattcggtgtcgcaggggcgcacccaggcgggctggctttttcaaaagcggtcttgcaaaaggctgcaccctctccgaatcagccgattcttgatgccggatgcggaacagggcaaacggcggcttatttaggacatttgctgtatcctgtaacagtcgttgataaagatcctattatgcttgagaaagcgaaaaaaagatttgcgaatgaagggcttgccatccctgcataccaggcggagctggaacatctcccgttttcttctgagtccttttcctgtgtcctgtcagaatcggtcctcagtttttcacgcctgacatcctctcttcaagaaatttcaagagttttaaaacccggcgggatgctgatcggtatcgaagctgctttaaaaaaaccgatgccccctgcagaaaagaagcaaatgatggatttttacggatttacttgcttacatgaagaaagcgaatggcataaactcctaagatcctatggctttcaaaaaacagaagcgatgacacttcttccggaagacatggaatttgaaccaaccacagaaatggatttatcgcaaacgattgatcccatctattacgatacgcttcaaactcattatcagctcatgcagttatatagtgagtacatgggtcattgtatttttatcgcgtacaagtaaaacggcgtatcgccccctgttttcgtccaacctttttttcctatctatcatatgctgatagaaagtcaggataggaggggaacaatattggagagatattatcatctttgcaaaaaccatcaaggtaaagtcgtcagaattacagagagaggcgggagagttcacgtcggcagaattacccgtgtaacaagagacagagtttttatagctccgaccggcggagggccaagaggtttcggttacggatattggggcggttattggggatacggagcggcttacggtatttccctcggtttaattacaggggtcgctcttgctggtttattcttctggtaagcatagaacaaatgctagattcaccagacacaatgaagcccgcttatctagtgtaagcgggcttttcattttaaattttcttcactttttcaaagtactcttcaagcgttaaatcattatcttggatgacctttgcggcttttttgcctacatagcgcagatgccatggctcatattcatatttcgtgatatcttctttatttttcggatagcgaatgataaagccatatttataagcattgtcctgcacccatttcccgtctgccgtgcttccgaacgcttcatttagctcaaagccattgctccggctcgaaatgtccatcgcgaggcctgtttggtgctcgctttcacccgggtaagcaaccgcttcctttgccttcttttccccttttaggcttacttcattgtcaaaaatgactttctgtctgtcatacgaacggtaccctgagacagctgccagttcatagccttcctttttggcagcatcgaacattgtttttaatgcgtcggccgcttcttttctgatgtaacgtttttgaatcttttcttcaaaagaaaactctacatctggtatgacaagatcgctaggttcatagtttccgggcagtgcatattgtttattgacaagcgcgagtatattttctggattttgaatggtttccagaccatcgacttttttaatatcattgaaatactggctttccaatgaaaactcactgttttgagtgtttgattttttgctgtcagctgttttttgttctgtttgctttgtttctgctgtggttttcgtatccttttgagcatctccgttcgacatgctgcagccggctccgactattgccgttacactcagagcggcagccagtgagaaccatttaccggactttttcatattacattaccttccttttatcaatcgtttccgcattcataaagaagaggctgccggcacccagcacgcctcttgatatattttattgtgatacggaatgtaaagccacttctatcatatcatgaaatgtcgtttgacgctcttccgctgtcgtttcttctcctgttaatacgtgatcactcacggtgagaattgacagggcttttcttccgtgcttcgctgctaatgtatacaatgcagttgtttccatttcaacgccaagcacaccgtattttgcaagtttttcaatttgcgaatcgtcattgtagaactggtcagctgtaaatacgcttcctacagtcaccggcacacctttatcctttgcggcatcataggcattttttaaaagctcgaaatctgcgcaaggcgcaaaatcaacgcttccgaaagcaactctgttcatttgtgaatcagttgaggaggtcatcgccaaaatgacgtctcgcactttgacatctttacgaatagcgccgcaggaaccgactcttattagattttgcacatcgtagctttgaattaattcattcacataaattgaaatagacggaacgcccattcccgtgccttgtactgagatttttttacctttatatgtacccgtaaatccatacatgcctctgacttcattgtagcattctacattttcaagatacgtttctgcaataaattttgctctgagaggatctcccggcaaaagcacagtatccgcaatttgtcctttttcagcacctatatgtacactcatctcatatcctcctgtaaatctaaattatcatccagcccgtccattttacaacgaatgtcatgatgaaacaaacttcagcattgattataaaggaatatgtcgaaaaaagaaatgttcgaggatctgttaggcacttcctcagaaaaacggataatcggggtgttaatttgaaaacctaaccgcaggaaggaggggtaggacatgggtaaaaaacatcgtaaccggatcaccggccaaaaaaagaacaatcatatacctgaaaaagatatcattgcagctgaagaagcacacgggaaagaatattctgctgccaaacgcaagccttaaaactgcagaaaactgcgggtttccgcagttttcttttcattatgtcgtttgtacaatcagacgattgattttcctccagccggcgggaagcagttgataatatgttttcccttttctgccctcgtcaatcaggatcacgtcccctgtggccatgaatcttgcatcataatcactcggaacagtgtcgaatacattaaacaaagagaatgctcttttcagcacgtcttgatgatcgctcccgttcagttcagttcgatagacggctctgtagccctttttttcgccaaaccggggtgtctgaaatattgtcacgtcataggaacaagacttctttttaaacacggataacatcatcaagatcccctccctcttatttctttaacatattggcgtttttgctgtgttttcctctctctatttttgtcgaaaccgcttaatcttttcgtcaaaaccttttactaggaaaaacagaagcaagccgaggctaaagccgcctaacacatccgtcacaaaatgaacccccagatacactctgcttatgccgactaaaacagcaattacaccggctatgatatataccatttttttatgcttggacaaaaacgggaggtgtttcactaaaaagtaagcaataacaggatagacacaagcagcattcatggaatggccgctcggaaaactgaaggatgattcatgaaccagcggtgcaaaatcaggcctcactctttcgatccattcttttaagactttgtttaacagccgatctgtgccgaatactaagagcatcaacaggccgtcccatgtttttctgtagaaaaacatgcctgctccaatgatgacaattagagggagcagaaaagaagaagcaccaagatgcgtgatccccgtcatgacttcattaagccatggctgacggatcaaaacagctgccttgcttattgcttcatctgcagattgaacagcatttgtatgaatggccgcagctagaatgagaaagaaaagaaacaagctaacgggcttgtacaatttaaccacctcaattttcacagaagtcatagaacacgaataataaaaccggagctgaccgctccggttttaagcctcactcatcttcatccagctcttcatctatcatacatttttctatcaaataatcaaaggtaatatcagcgatttcaaacagctcatcctcactcggtatgtagccccgtcttgcaagctctctgtaaaaaaattcagcgatttcttccgtatcaatcacaagatctatttctttcatctccgtaccgcctccttttttatgttttatgaaaaaacaggctgaattatacccggtgttctaaacaattctttcagtcatatattgaataaaaaacgagccatgggaggctgacgctatgattgctaaaatgatggaagcactggacggagaaagatttgatatcataatggaaaaaacgctcaaaggaatgacgcgtgtgatgatttggggctgtctgccatattttttatatgtcttgatccgtatgttcacaaactaactgaaatgctcttttaaactttccaaaacaaacatcatcatgtctttatattcttcatcctgaaacatttcgtacagtattttgtagtcattataaatatccagaagctcatcaacaattgacacagcaaggatgtgaagggtatcttgatcttcatcatcgccttcaaactgaagaagagcagacgatgcgatatcttcgccgatctcatggccagtttctccgacataatggacaaacaacagctgatgcacaaactggtccatttcatattttctaagcaccagcgtgagatcctcttcctccgtttcaagccactctccatcctttaaacgggtcagttcataaatgatatcttcccagccatcttctaaatatctccaaatttctgttctatggccgataatgcgaaagagttcttttccataatcttttacataaacaacgtccccaataaggaattcatactcaatatcaagcttctccatgtcgacaatgacaccctcataatctttataaagctgaatagatgattcaaagtataaaacttcgttatgattgacttcataaagatagtgtttatcaatttggtgcacttttgtgatggtgccgactgttccatacataatgacgactacgatatcccctacttggaatttcggtttattttgcttcatggtgtctccccctcgccgcaacatttctcatacgctatcgtatgccgggtgaagccaattcgcatgggcatgaaaaccaaaggaaatatccaattatggtatgggggacataaaaaaatccgcagtgatctgcggatgaaacagctattatctgccgtgcacttcagactcgtattgatcccaagcttcatcaaacgtcgccatcgtgtgaaggtaatcagcattcagctccaaatatgaactgatttcatgataatcggtagatgtttttggaaagctgtgatcctcatacgcctgattggcaaattcactgatgctgtccttcggcttagggtgcctgtatttcaataaatagtgataaaaggatttcatgggtttcccctcctggtgtctgtcttttgttgttctattatacagttcaagtgtaaaattacaacaaaagaatactgaaacatgactcaggagaagtcaaaatagttgcgtttcaaaattctttctgtctccatgagctgctgatatgtcaggctttcaggcagtttttttgtttgaattaaaagcagctgatcctcaatctcctttaccgtgttttcctcttgataggtcataccgcaggaagaacataccatggcaggggtgtctgtcagttctatagcccttgttccatcagggagctcccagtacaccgtgttcctgccgggcaccgcttcaagctcgccgcaccattcgcatgttttcatgaagaatcccctccgcattcagtctctttctgttttttctgctgcgccaaaaatttcttttctttgagctgatctcttttctcacgccgattttttaatgtttcatgctccggatttgcgatgtatgcctctctccttttgattctgtctacattttcaggtgtaaacgaaacctctttgtcagcaaaaatggcactcagcccgatcggctccttttcgtcagcggtttcagggaaaacggactcaaaataggcgtctgcctgattggggatataattctctggttccggatatgacgtaatcacaccttcaaaatttcttaagatcactttgtcaggactttgtgacaggacatagtttggctgcagggcgattttaccgccgccgcctggtgcgtcaacgacaaaggtaggaaccgcatagcctgaggtatgacctctcagcccttcaatgatctccaaacctttggaaacaggagctctgaaatgcccgattccctctgacagatcacattggtaaatataataaggacggactctgatttttaccaagtcatgcatgagctttttcataattggaaccgaatcattaatacctgctaatacgacagcctgatttccgaccggcactcccgcgttcaccagcttttcacatgcctcaacggattcttctgtcatttcgatgcttgtgttaaaatgggtgttcagccagaccggatgatattttttcaatatctcgcacagatgatcggtaatgcgctgcggaaagacgacgggcgctcttgttccgattctgatgacttccagatgtggaatgctgcgcagctcttttaaaatatattctaaaatttggtcgttgatgagcagcccatcaccgcctgaaattaaacaatctcggatttcaggtgtttcccggatataagcaattgcagcatcaagctgttttttggggactcccattccgatttgtccggaaaagcgccttcttgtgcagtagcggcagtacatggaacattgattcgtgacaagaaacagcacacggtcgggatagcggtgtgtcagaccgggtaccggtgaatcttcatcctcatgaagcgggtcttccagatcgtattttgttttgtgcatttcttcagaaagcggcacagactgcatgcgtaccgggcatctcggattgtcggggtccattaaagaagcatagtaaggtgtaatatttaaggggatcgttttagtagaaattctgacgccttcctcttcatcctcagtcagattgatgactttctttaaatcatctaacgttcttacagtatgtgtcagctgccaaagccaatcgttccatttctcttccggaacgtccttccataactcgatctccttccaatgccgtttcggtttataccatttgtttttcaaacgaattcctcctcgcgcatattttgacttacagttgcttgcaccaaatattcatgttttcaaggccttcggctataaagcaattattgatcagccttccgccattttgataacctgaatggtacaacacagcattcatcccaaaagacgaagcacgggcgagagaaaatacatgaaagatatcctttccagccatttctttttctaacgcctcgattaaaaagcttgttaacgaatggccgcgatattccggcagcacagcgcaatcggttatttctgcatgcccaagctctggattgatttctgcgcttgctgagctgatcaggcggtcatgatcaagcatgatataatacaccgtatttgcattcatcgtcttttcaatataagcggggtcaaataccggtgttgggtacgtgcggaatacttttttatacagcatcgatagctggtacatgtcgtttgtttctgcttttctcatcgtaaaaacgggtgtactgtcgttgcgaagacggggcgctgtgcgatatatggcttcgatgatctcctgttcctctgtataagaatctgtttgtctccggctttctgaaaggtaacgtaccatgacacaagccgaatagccgagataatagccctttagatagccctccggcgcaaataattgtttggcaaggatcggctcatcatgctgcttcgcatagacaatgattttttctgcattctcttcttttgccgctgccaagatatccggcagggccttctcaatagctccgtcataacggaccactctgattcgtttattaaagccgtcatggtccaaaactgctgtgacaccgctactctttattgacttgagcatccgcatcctccccatctgtatgaagcccgcaccaatccatgacaaaaagtgcaataattttagcagattctatcatggcttcaacctcaatgtattcattggcctgatgagccgtttttgtttcccccggcccgaaaacgatcactggtgtatctcctgcatggtacaaaagccctccatccgttccccacggggaagcctcaataatcggctctgtctgtttcattttttgataggctgattgcagcacagaaattaaagggtgatcatcaggtaaatcattcggcagccattgagcgccaaaccattcgacttgtacgggatggcgtttaaaccattcgtcatggtattctaaatccttcagccagttttccaattcaagttttacagcttctggtttctcatggggagcaattccgcatctcccttctataacgacacggtctgcaactgaagatggccaggcaccgcccgagatcgtgccgatattcaccggtaccggtattgggatattgtcatacagcggatctgaaattctcgcattgcggactttctccagctcttgtatcgctgtgataacgtgcatgcttttttcaatcgcgcttaccccttcatagcgtgtgcccccatgtgcggctaatcccttcacagtgatccgaaaccacatcgaaccctgctgcttaataaatagtttcatattcgtcggttcaggaatcaacgccccgtcagcacgatagcctctcatgatggcggacagtgtaccggcgccgccgcactcttcatctacaacactctgaaacaatacatctcccttcaatttgacatcgcaagcgtgcagggcttctaaagcaaaaagaagggctgtattgcctcccttcatatccgttgagccgcggccgtatattttaccgttttcttcgacagcttgatacggttcatacttccaatcctttacgcttccttcaggcacaacatcgatatggccgttcaaaatcagggacctgcctccgccggctcccgtttttttagccacgatattcgggctctcatgaaaatcggatcggttagatttaaagtagggatgctgttttaattgctttatacttggctcccatacatcaatgtccatatgaaattgccgcagcttttcaagcacaacagcttgggcgttaaactctgaccccaatgtgcttttttccccaatcagccttttgagaagacgaatggctttggccgaatgctgatcaagccacccgattacttttctttcaatgtcttgcatcctcattccccctcttaagaaaaaggcatatctattttgatttcagcatctgtcagcctcgtcacctcatcgattgtcgagccattcatcagctcttttaaaatgaagtgatggctatcgacctcaagaaccgctttttcggtaataatcaaatctacacagcctgcagcagttaatggcagcgtgcatctttctgttaatttaggccttcccttttgatctgtatgactcatgacgacaaccacttttttcgctttttgggcaagctccatcgccccgcccataccaggcaccttttttcccggaacaagccaatttgccaaatctcctgattggctcacctgcagggcgcctaaaatcgtaatgtcaattttgccttttctgatcatcgcaaaagacatggttgtatcaaaataagaagccccttttacagcgcggacaggatagcccgcggcgttgcataaatgcgcatcctcttctcccttttcgggactttctccaatgccaaggacaccgttttccgcttgaaacatgacctgcatgtcaggcttcaaaaagttcggtaccaaggatgggataccgataccgagattcacaatcatgccctgcttaatttcagtagcagcccgttttgcaatctgttctctttctgctactcccaagcccatttccacttcactccctcgcttcttacaactccctcaacaaaaacccccggtgtgacaatcatttcttcagaaatctcacctatcggaacgatacgctcagcttcggcaaaggttctcctggcggccattgccataagcggattcatattgcgcgcggttttgtcatacgttagattgccgaattcatctgcaatgtaagcattgatgaaagcaaaatcagccgtcagcgcctcttcaatcaagtatcgttttcccgccactgttacgatgtcctttttttcgcaaaccatttgattatcaatgcccacgtcggttaaaataccgccaagccccgctccgccggcgcgaatccgttccgcaagcgttccctgaggtgaaaattgaacctctaacgtcccctctgtcatctgttttccggctacaggattggaaccgatatgcgaggcgatcagggttttgacccgttgattaacaataagcgggccgatccctatatccgggaaaccggcgtcattgcagatcacagttaaatccgttacaccgctgtccaatatcgcttcaatcaatgaaggaggcgacccgactcccccaaaaccgccaaacatcagaaccgatccatcccgaacatctgcaattgctgtgtcaatgctgattgctttttgaaatgacgccatttaatgtcaatccttttttaagtttttttcgaccgctgcaactgtttctgaaaaaatagagataagctcttccatttcaccgtctgaaatggtaaaaggaggagcaataatgacagcatctccttctccactgtctattccagctttggaaggataaacaatcagcccgcgttttttcgcctcgctgacaataatctgagttatcgtctgctcttgcggaaacactttcttcgttttttggtctgccacaaattcaacgcctaatagcagtccttttccgcgcacatcacctataatgccgctttgagatgccgcctcatcaagctttttcttcagcacagcgccctttttttctgattgtttgatcaagccgtgctttaacacatatcgcaaaacttcaagagcagctttggctgaatagggatgtgcactatatgtgtgaccgctcataatcacacctgacccttgttttatcgtttcaataatagaatcagatacgacggcagcagcaataggcgcataaccggcaccgagtcccttccccagtacagcaatatcaggtacggtgtcccaatgctctgtcgcgagcatccttcctgttctcccaagccccgtcatcacttcatctgcaataaaaagcacatcgtgtgtgcggcatacctcacttaatctctcataatatcccggaggcggagtaatcgctgctcctgcagcaccaataataggctcagccacaaagccggcgatgaattggcttccgattcttttgatcatagtgtccagttcatcagctgcagtctgaacaaagtcttcttctgtctcgtgattcagccgataaatatgtggagctgagatagctggataccgttcaatgagatgggtgaaccggtatctcctttcataaaaaccagataatgaaagcgctcccaaagttattccgtggtaactgctccatcgagacaaaaagatggatttttgtgtttgctttttttcctgccaatactgaatggcgattttcatagctgtttctatcgcttctgatccgctgttgacaaaaaaagaccaattcacatctccgggcagctcctgtgccaagagcgcggctaattgctcggcgggctcactcgtaaactgtgagcggtaagcaaaagacacctgatcaagctgttctttcagcttctcagtcacatcacgaactccgtggccgatattacatgtcaccgctcctgacgagccgtcgagatatttttttccggtctgatcataaacatatgaacccttcgcataactgacaaccggataggccgagctaagctctggcttaatcaaataactgctcatgctcccacctcaaaaccccttttaccatattgtatgagtgtccaaatggcggcatgacgttccccgcaaaaactttttcacataaaaagagccttcctaatagggaaggctcttttggaatttcagcatctagcaaataaaagcggctccaacaataattaataaaatgaacaagacaacaattaacacaaatgtatttgtcccgcagccaaatccgtaaccgtacccagagtatccatacatgctgttttcatcctttcttatcacgatatacggcattttatgcgggccaagtcccaaatggtttgtgcaaacgcctatttcatgtaaggaaataatgaaatacagtatgcacccgctcatattttttaaacgtcagcttttcgtaaaactgagttgcaccgtcagtgcttgcagcaactaagtaggctgcttccattcctagtgatttggcgatggacagcatttctttcactaagatactgccgtagcccttcctttgaaactgatctaaaattgccacttcttcgattttagccgttttctcttgatgatcgataaacagctcgccgcacccaatgggaactttctgtgcctggtcgctgtaacaaacaacaagaatgattatacctgcttcatagaaaggatattttctttttaatttttgttcagcgattgcttctccaatataaatggaatcgtaaattttcataatagaagatccgtcgctaagacttttcgccgtcccccatgcggttaaaggatgtcccatctgccccttccagtcactaagcttcatgtcatatagtagctcatcctcgacgacaaaaccgctttttacaagcgactgcttcaaaccgagcggaaaaacatgctgcggcgacgcttttaaatggagataattcgcatcaagcagctttggtacggagggtaaaaagttaagtaaccgctccaatggaaacgtatcatggagctgaacaaagttatgagaaaaaatttgcggaagctgcggatctctgtatacgctgtaatgatcaaacgatgccgattcagacgttaacaatatatattgatgttccgtttttgaataatgtcctgtcatgaacgtctcctttttatgacctatacctttactctgttgcaatattcaatttctttataatctcatcgtacaccggataaaacggctttccaattggaaattgctgaatatttcggaaagaagcggagattggcttctgatgtaaaaaaaacttccttgttacttgttcactaatcgggtgaaagacgccgtttagaaacaaaaacggctcgcgttcgatgaaaaacagacgtcggccaggcggatttttgatcaattcagatcgtttccacgtaatcggcggcccttccggaagcgcctccatttcttcttttccaattgtcactatgtcttttctttgaaattgataaaattgaaacgcatactggtccacaattcgccttttttttccggcttcgatataaaatattgcaggatggtcagcttcctttactaaaatataattcggaatgtttaaaattttgccaatcctatattggaataaatatgggtctggaacagcgacagtccgatttagatacaaaaaaccccacttttctccaacaggatgccttacaccctgatcaaaaaaatacacattttgatctgaaccttttacaaaagagccgtcaatcaaatcggcgggcagaaaccgatatgcattttgaaatgaatctggggttttataggttgtgtctaatacttcatttatcggcagaaatggggtaaagttgttgagtctcgcccaaaaaattgcgtcgccatgattccaatgcttcatatcatcatcccagtagcctccaaatttatgatggatgagattaagtaacgaacggcgatgcataactgagcaatgatcaacttgaaaagcggcctgatcaagcactgcattggcatttctgtagaaatgtgagatttcctctcccctttcgtttacatgtacaactttttgttttgaatagaccgcctgcgcttcaggcttatgtgaaaactcttgcaccatacggctcagccgctcaggatgataaacagtgtcgtcagtaagataggaaatgtaatcgccgtctgcaaatgggagcgcactgttaattaatgtggcataacgggctgtttttaatcgatctgcaggatgcacgaaactgttatgatattgaatgcgccggtcatggagatacttgtgaatcaccgcagttgtttctgcattcgaatgatcatccatgataaaaagctcccaaagatcatgcgtttgctgtatcacgctttcgatcgctttttgcaaataatcgggtttgttgtaacttgttaaaataatagacactttctctcccatctataccgcctcccaccgtcaaacataaaaacggctccgcagcaagcagagcctctgtcatcatttaaaaagcaccccagcttacaacacttgagagtgaaacatgagctctcgtgttatttaacgggttttggaaaataaccaaatcagtcagaacttcttttacgatgacattttgaagtgtatctccgttgatcaaattgacttttgaaaccggtacgcccagctcttttgcaaaaacaagctggcgtctgaggtcagatggatttccttcagaagacgattgacgtatcagcagaatcagcaaaagcaaaataaaatgcagatcatcttggttttcttctcgatccacttgtttctctaaatccaaatcatccctctcccttatccttatctctgtttcacaatatgtgcgacttcgatttatggtataggctatgtccactccattaaaaaatcagcattttccttaaatagatgaaaaatagatcaggtacggcgttcgactcataccaaataacagccggaagaatatgaataacgtgagttcactatcgaataggaggtgtgtgtaatgagctctgaaaatgcacagttaaaaaaggatttaattaaagccgttttaagccctttatttccaactgcaacagaaggaggagaaaatatggatagtaatcttaaagccttgcttgatgctgccatcgatcaaaaagtagatgaaagtgaaacggttacggcagaatctattttagacccttctcttccggcaagatggatttttgccagaattacgccaggcacgacaatcagcattgtgactgattcaggtgacatgatcggaccggttgttttcgttgctttcgatcaggttcacgggatcgtatttgtaacacaggaaagctccgtcactccggcaggccaagctacaacattaattgatgtagacaaagtagaaagcgttacgttcttttcataacatccgatgaaagtcttgtatatccagtcgggatacggaggaatatacagttattttgatcgctgggctgaagaatgttttcagaacactcatacagagtatatgattgcagataaacctgaagcagaatctttgatgaagatcgaagcgtttcagccggacttcacacttatgatggttggagaccgcgttcctcacgactggctgacctggttaaagggtaaggatatccccgtgtatgtttggctgaccgaagacccattttatatggatatcagccttcaggtaattaagcttgctgacgccatattaacgatagaacaaaatgcagctctctactatcaagagctcggctaccagaacgtctattatgttccgataccagttaaccatcggctgtttaaaaaaatgggcaccgaacattcctatcattcaaatctgttaatcatcggctatccttaccctaatcgggttcagcttacgaaagaagcggtccatctgccattcacggttcgggtaatcggcaaggaatggggaaaatatctgcctaaaaaagtgctcaaacagccgcatattgatgtcgtcagcacatgggttccacccgaacaggccgttcattattataatggggcagacatcgtaattaatgcgcatcgtccctatcattttgctttcaaccaaaatactatgcgcatcaaaaatgccagttttaataaccgaacgtttgatatcgctgcatgcgaagcatttcaattaacagatttacccgcggcgcatcctttttcatcctttatttcttatcacggcatgaacgactttaaggaaaaagccgctttctatatcaaccaccctgaagaacggcaaaaagctgcagcagccaattataaagagatcgtacccgcatttacgtttgatgagcttcctgcaaaactaaaagcgattcatctggcgctctcatgaaaaatcgttcattgctatgaacgatttttttattcatagaaaaaagcagctgcacaagctgctttctattctagccgtcagaacggtctttcagcttcctcggatttacctgtttatgaagatcaggcatttcgccgagatgctgtgcaatttgttcccacgatacaattttgaaattttgattgacggcttgtccgttatcgatattttcgccgtcctgcgccacaaaaatcccgtacggatattttgggccaagtccgaaaccgagaacatcaataccatccgtgtcactagtaccgtctatcttctcgccatctgtaatctcaaagttggctacatagcgatttttcccctgccgttcatacattgcatagctgttatttccttgacttgaagccatgagatatcctttgccatttggtgcataatagattgtcagtccttcaatatcagctgtcaaatgatctcctgtcgcacggtcaacaacctgcccctttgaccctccgccgggctcagcgttaaatttccagatggcttcatcttcctctgctatgtataggttcccatactcatcatccgcaacaaggccttcggtctgagaattcaacttaaattcacgcacctttttccctgttacataaccctttccaccatcaacaatttcatactgctcaaattccccttgtttgcctgtcactaatgcgtaaaatgctcctgttttctggctgtgatacaagctgaatccataaacctcagaaatattggtggaaataggatggttcggatctgtaatgcttttcaattttcctttatccccgtctattgcatatacttcaattgtattttttccttcggaccggttggatgcggcagcaatatcaattttttcgccgttcaatggaaaatcatagcgcagatcgacattattgagcttgccaaactcataagaatgaagctgttttccgtctaaatcatacacaacgagccctgacttcttatttgttgtaatcaacttgcttttttccgggtgtttttcatgaacccaaatggccgggtcatctgctgcatcatcgccagatgcgaccggatctgtctccgtgtgtgcagtcactttgaaatgatgttcctcattcacataatgagccgacaccgaggttgctgtcaggctaagcaataaacccgcggcagtgcttagcagcattgtttttgaaaccttcatttggtaccctcctcttttatcactaacactactattgtaaaatatatacaggtgattaccgtgaggaaaatgaacctttttttatagggtttctgactcataaacaacttattccccaaagaggtggtgagatgactttgccagatttacttttgcggagcgaaataaaaatatgttgaatatttagtacattgtttatttagttttgttttttcctagttacgtccgtttttccattttctattaaaaaagaacactttgtgacatgatcattcccctaaattttgttttattggttgctttcattaattcgattacaaagttgaacatatgatgcatggtagagaaacgagagttggaggataagccatgcctaaacagcaaacagcagaactaaaaccatttttccataacaaaacagttttagtcactggcggaacgggttcaatcgggagtcaaattgtcaaacgccttttgctgcttacacctaaacaggtgattgtattcagcaaagacgacagtaaacagtatgtcatgagccaaaagtatgcggaggataagcggctattatttgtacttggagatgtacgcgatcacagaagggtgaatcaggtgatgaaaggcgtcgatatcgtctttcacgcggctgcgctgaaacaggttccgacatgtgaggaccatccatttgaagcgatccagaccaatctcatcggcggacaaaatgtggtggaagctgccctttcacaccgagtgcagcatgtcattaatatcagtacagataaagctgtatctcctgtgaacacaatgggtgccaccaagctgttatctgaaaagctgtttcatcaagcaaaccgccacgtccaaaacaaaggaaccttgttttgttcggtccgctttggaaatgttctcggttccagaggttcggtcatccccatattatttgaacagatgatggagggtgaacccctgaccatcacagacaaaaacatgaccagatttttcatgtcaatagacgatgcagctacattgacattacaatcggctgctattacaaaaggcggagaaacctttattttcaaaatggaatcactgaaacttgaagaactgattcatgggtttgaagaatatgcatcgcagcacgggctcccgcggccggctgcagtagaagtgggcaagcgtccaggtgaaaagcttcacgaagaattaacatctccacatgaaattgaatcactgtatgaatggggcaacctttatgcgatccttccagagccggaaaaacatcctgactttcgcaaagtcaatctgcctgggtatcaatcagatcaagccccgctcattacgaaagaaagaattgctcagattattgaagaattgcatcaagagaaaaaggcataaaaacaagcctgtctatccattaggcaggcctgtttttaacactttatttattaaagagatgcagatagctttcgtatccttcttcttttagcttatgcttcggaacaaaccgcagcgctgctgaatttatgcagtaacgaagtccgtttggaccaggtccgtcattaaatacgtggccaagatgagaatcagcagttcggcttcttacttctgtgcgaatcatgccgtggctcgtgtccagtttttcttccacttcttcttcttcaatcggctttgtaaagcttggccagccgcagtgggaatcaaatttatccttggatgtaaacaatggcttgcctgacacaatgtctacatacaacccttcttccttatgatcccaatattcattttgaaatggcggctccgtgccgttattttgcgttacttcatattgcatgcgatttaatgactttattttttcttctttattgtacgccatttatttagccccccaatgctcgctgataaatcccgctcgtccggaacctgtccggtagcgctgataatgtgctggattctttttataaaaatgctgatggtagccttccgcttcatagaaaggttcagcttttaaaatgtccgttacaatcggatctttaaagatgccgctttccgccagacgttgcttggaagcttccgcaagctccttttgtttatcattatgataaaaaatggctgcgcgataggaactgccgcgatcagcaaactgccccccggcatctgtcggatcgatttgctgccaaaataattcaagcagtttttcataagggaatacatcaggattaaacgtgatttgaacggcttcacgatgtcccgtcgtttcactgcacacctcttcgtacgtagggttttcagtatggccgcctgtatacccggacaccactttttcaattcccggctgttcgtcaaaaggtttaaccatacaccaaaaacagcctcctgcaaatgtggcgatttcttttttttcagacatactggtgcctcctttgttaatacgtggtattattatattatagcatgtaaaaatagaatgaaaatgattctgcttttcaataaaatctataggttttaagcaatatgcttatgtaatggaggttcacaaatttgaaagtaagaacacagatgatgtacgatatggaaactttactccgtaaagtctttaaacaaatacgcaatgaaatcaatgaaattttagataaagagctgtcgcggaatgaattcaccattcttcgaatccttagtgaacaagggcctaaaaaagtcactgaatttgcgcctattttagaggtatcggcaagccacattacggctgtgaccgatgcgctggtagaaaaggaatggattacgagaatcagatcgaaggaagacagacgcatcatccgcattcatatcactgaagcaggcgaaaaagtccttcagcactttaacgagaaaaaaacggaatatttctttaaacgctttgactgctacactgatgctgaacttgccacgttaatcgagctcttcagcaaacttgataaaaaacggtgaaaaaaagcacataccgatatataggtatgtgcttttcgcagtgcttcacttatttttcagtaaacagcttcattgctttccagcggccatatctataatacaaaaatgccgcgcagctgctaaataaaaaactcattccgattccaagcccgattcctttttgtccaagccaagctgaaaatagagctgtgaaaggatatctcaacacccaaaacgagattaaatttaataccagaacctgcagcatcgctcccgcggccctgacgattccgttcagcacaaaattaatcccaataaaagggtagaaaaacgcgatccacttcaaatattgttcaccaaatgcgaccgcatcaggctcactgataaataaccttatgagatatttaccaaatacccaaatcataaccgcaatcaccagcatgcaggaaataacagctatcacacccagccttgcaattgttcccactcttttttcgtttccgattccaatattttgccctgccatactattgacggccgtaccggcagccattgctggaagcgtgatgatgctatcaagccgctgcaccgcgccaaatcctgataccacgtgatccccgtatgagttaacaacactcataatcgccatcataccgcctgtaatcaccatcatctgcagacctgccggaatcccgagtttcaaaatcagcgcggactcttcccacttgggcattctcggaatcgagaatggcacaagcttgtgtttgatgacataaaacaacccatacaaaaacgcaatgccctgtgacaaaatcgttgaataagccgctcccgctattcccatgcggaacacagaaataaagagcggagcaagcactgtattcagtacaacagcaaacgcaataaaccggagaggtgtcttgctgtcgcccagcgcacgaagcacagtactgataaagttataaccaaacaaaaataaaatgccgataaattgaatctgtaaatacgtctcagcaagcggtatcattgactccggcgtttttagaagacgcagcaaaagctctgagagaaaaaaaccggccgcgccgaatccgatgcttaggcctgttaataaaacaacaaaagcgttaatatacgacgccattccttttacatcatcttttcctttttgctgagataaaatggttaaagtcgcattgttaaggcccaaaataaaagacagcacggtcaaaacaatcgtgcttgataccgcggctgccccaagggcctttgcccccagtaaattgccgatccacaagctgtctataaattgaaaggaaacctgcaatgcgtttccaagcataataggcattgaaaacagtacaagctgtttcagcacgttcccctgtgtaaaatcgtatgctttcatcttttctccttgtgttctcaaattttcttcggaccgcacgaaaaaagagacgttgtttcatgtctcttttttcatgacttatcggttttttttcggtctcgcataccgaatgtaaacaccatcacacttaggaacaaggcacaataggaaacattcaaatacatttgatccatgtcttcagcagccagatgatgataagcaagccagccgaagtacagggaaaatgtaaaggataataaactgaaatactggtaaatctttttcattttcagtcacctctattgtttaggatggtaataggaaaactcaatttcatctttttctaaatttatcttatccgctttgacatacattccattcgttaaaggcatttctgacaaacgcacttcaatgcttttatctccggggtgaacatggacaaatgacggcaattcataaaagctgtccatataatttaacacaaagctaattggtatactcaatttccctaacgaaaatttcgtgacattcagctctacatcaccgttttttttcacggtcggctcaaaagcgataaacgcatcaatagacgtggaaaatgccttgattttccctgcgacatgaacatcatcatcaatctctactttataatcaagcttatttgatgctttgtcgtttaaatatgagttaacaaacgcagctaatgattcttttgtgcttgtcacttgaaatccatactcgctctcagatgaatccttcacctgagcctgttcccccgggagcaaaacaagtgccacaaaaccggcggcgaggataaaattaattgcaagcaatataaaaaacagtcgcttccacttattcatgctgtcaccctactctttcggtaatccttcttttttaatggcttgatagacgcgctttgcgataagagaataacccgtaccattaggatgaaaatcatcttcctcagaaattcggctgctgtcccttttttgattgaacaaatcttcgatatgaacgatttttgcatgtttatcttttttcagctctttttcagcaatatggttccaatccgtgacgacaccatttatttcatttagttctgataatgtaaacgtaaacggattgtacatactgacataaatcagctcagcgtgatcattcagctcgcgaatttcagaaatgattttttcaaagcgcttttcgtacggtttttccgcttcctgaaacggttcaacggttaattgcagaaagttttggcgaaggattttcatcaaatcattaccgccaattgtaaaaaagacataatctgcgtcctttatgcctttttgaacctttttatcttttagtttttctaataaatcatccgaacggttcccttttacagcataatttttcacgtcgaccgttttgacttgtttatctgaccggatagaatccgccaccttgccgacatatccctttccttcgggatctccgactccttctgtcagcgaatctccgacagccgctatgacaatgtgttcttttgttttcgtttcatgggctttttgttttccctcagatgatgtacgtatgctcgtacacgcagtaagaagcaaaatcaaactggccatgattgaaaaaatgcgcagcttcaatcttgttgctccttcccattctactagtggaaagtgtatcatgttttagaagatttgcaaatgcctagtctcttagcttacttgagtgtactggctgactttacatcggaaatgatatcatcgtacggtgtattctccactccattgtaatctttcagcaccttaccgtccggacctaccaaataaaaagaagattgatgaatcacttggtcctctccctccggcttctttacgatcgctttaaagctcttaagtgcgaactcctcaatctcactctggctgtatccagtgagaaaatcccagttatcaaaagataatggataatttgcggcaaatttcttcagctgtttcggcttatcgttttctgggtcaacactaaatgatatgatgcggacatctatattttcggctttcaattttttttgcagatcggtcatatgagcggtcattggcggacatacagtttcacaattggtaaaaataaaatccgccagccatacttttccttttaagctctctaaagaaacgttcttgccgtcttggttttgaaatgtaaaaggctccacctcgtaattgagcggatttttaatctgctgtcctccgcatgcacacaaaaacagaaaaatcagcccagccgttaaccccttgataaccttcatgacatccatcctttccagccagcataaaaacgctttctaaaaccgtccttactgtcccatgtttgtattcgatactgagcaaaaaaaatcctgcatgcctccccattaacgattacaaaggagggcatgcaggtaaaaaacggcatgttacgcgttgtgctttaacacctcttgatgaaatacagcctgataatctgcccacttcatccggcgcttcatataatgtcggaaagaatacacttttgccctgctatttgatgaaaacacttcttttaagtagaattgcaaatggtgatgtaacataaagaaatagtgctcatcttcctttaatacaggtatttctgtcactttcacctgaatcccgtcaccgcgtttgaactctaggcttttgagtaacaagctatcaatcctcttttttgtttttcttctattatatatgatgccagccgggctgtctgtcattttgcgcggttgtgtaaaaaaattagattagcaaatggaacaagtcctcatccttgttcacctctacataatgaaacggttttttgttcatccgttcaatcagcggcccataatcggctttgttctgcagctcgatgccgacaagagcaggtccgttgcttttattatttttcttcgtatattcaaaccttgtaatgtcatcattcggcccgaggacttcgtcaagaaattcgcggagcgctcccgctctttgcggaaagttgacgataaaataatgttgaagaccttcaaaaatcaaggaacgctccttcatttcctgcattcttccgatatcgttattgcccccgcttaccacacacaccacgtttttccctttaatttcatccttgtacaaatcaagcgctgcgacagaaagagctccagccggttcagcaacaaccgcacattcgttatataattcaagaatggatgtacatacttttccttcaggcacgaggagaatgtcatcaacgacagtttccagcgtccggaaggtttcctcgccaatttttttaacagccgcaccatctacaaacttatcaattttatcaagtgtgacgacatgcccagctttgtttgattcaaagtaggatgccgctcccgccggctcaacagcaattacctttgtatcaggagacacgtttttcaaatatgtacctaccccagagagaaggccgccgcctccgacacttgcaaaaagaaaatgcggttctgtatcaatgtcgtttaaaatctcgactgcgagcgttccctgtccggccatcacatccggatcatcgaatggatggataaacgtccgagattccgcctcacagcattcagcagcgcttttatacgcgtcgtcaaacgtatcgcctgtcaaaataatatcgataaatccttttccgaatagttcaacttgagatactttttgtctcggtgtagtagacggcataaaaattttcccgtgaatgccaagatgtttacacgaaaatgccacaccttgagcgtggtttccggcacttgcacacacaactccgttctctgtctgctcgctggaaagctgtttcattttatgataagcccctctgagcttaaaagatctgacaacttgcaagtcttcgcgttttaaatagatattgcattcatatctctcagaaagtctgtcattcctctgcaaaggtgtgtgaatgacaacgtcctttacgttttggtgagccttcaaaatgtctttcacttggatgagagagttttctttaagcaacggtttcatgtacagattcctttcttgttttaaatccctatttaatatgccattataacatgaatattcaaaaaataagacaattatttttatttaataattaaaaaaatacagactatgtccaccacatcttgtggtaacttctgttcaaccattatcctgcagagccaagaaaaaagatgatcgtaaaataaagggtgttttcaaccaaaaggcatgatataatgaaaccaattagaaccaaaaggagccaattgatgaatagtgcaccaaaactcaatacatttcaacatctaatcggagaacatcaaactttcctggaagcgaagcgaatcgccaagcagttctcgttatcggagcttcctgtcttaataacaggaaaaatcggaacaggcaaaaatcacttcgcacatgccatacacttggaatcttcgagaagcaatgaaccgtttataagcgtcaattgcagcacccattcggaagaaacccttattcatgagctttttggccctaacggaaacacaggtgtttttcaaaaagcggtacgaggaaccctttttcttgatgatgtatggcgcatgcctgcttctgtacaagctcagctgttaaaagcgcttgattcagacacggagaaaccgcgaatgatctgtgcttctgcagaccgatctgtggaacatacattcaggcaagacttattctacagactgaacattttaacgctcacactgcccgaattatcggaacgaaaaagcgatattccgcttttgacacagcattttctctcaaattccggtcagcaattgttaatcgatccctccgtttttcccgtgcttgagaaacatgcatttgaaggcaatgtcagggaattaaaaaacgctgcagattatatggcggcagtatcaagcggaggaacgatccagccatatgacctgccgccatatattagaggcgcgatagacggaaaaacgtcgaagaaaaaagcgaagctgctgactttaatggaaaaagctgagtttttgtttattttggaaacaataaaagtattgaacgaaaaaggagaacctgccagcagacggatcatttctgaacacagcaaaaatacccaaacctcgttaactcctcagcaggtcagaagccgtctcgactatttggagaaaaaagattatgtcaccaaaagccgcggacgcgcaggcacaaaaattacctttgagggcttgagctttatagagacgttaaaaaatcaaatgatctagcgatcgaaaggagaatgcacttgtttacaatcaaagaagagatcgccaatgcgattacacacggcatcggtgtcctcttatccatcccagcattagtgtttctaatcatatttgcggctaattacgggtctgcatgggacattgtcagctttacaatattcggtgtctctatgctgctgttatatttgagctccaccctgcttcacagcatcacacataaaaaaacgaaggacattttggagattattgatcatagcgcgatttacgtactcatcgccggaacctacacgccttttttgcttgggccgctgaaaggcacactcggctttaccctgttggttatcgtatggtcacttgccctaggcggaatcgtttttaaaattttctttgtgaaacggtttatcctattgtcaaccttcgtgtatttagtcatggggtggctgatgattattgcaggtaaacctttatatgcttcactgagcggagcgggtttcagcctcctttttctcggcggcattttatactctgtcggaaccatcttttacatttggaaaaagatccccttccaccacgccatttggcacagctttgtattgggcgggagcgctgctatgtttttctgcgtgctcttctattgtgtaaaggtgccgttcctttcgtaacagtaacagaaaagcgcagtcttcacgactgcgcttttttttatgcacgtaattgtttttcattggcaggtatataagcttttgaaaaggacaattcaatgtctgccggttttaagcgtttaaaaaacgagcccttttgcatgttatctgttcctttcgtttccaccatcaccaacggaagatgatagcgggccgcaagttctacaggatcaatagaaccatctagtgaaagaatcaggctttgtcccttttccagctgttttgtcacatcttcatataccttttctgaatccccgtctgaaatcacatccatccgatccagccattgcccgataaaaggcaagcggaacacttttgggttggcgataaagccggccggttcctcaatatatccagcaattaaggccagttcagccaaacgcaaacggggatgcacatacaaaacaggaccgtgtggtattggctctggctgatggatcgtcacaactgaaccggagatgccgatacagccttccaaaaacgcctttggctgttcgtacacaagagtcatctgttttttgtatgacagacggggatcgagcattgtttgattaaataattgtttcatattttttaacagcatatacacaatataaaccactagaaggctgtagcgaaccaattaaaatcctcccgctttagaagaattctttttttcatacattagaaattcgtaatcatacgggtttttttcgtctttggtcccctgctcagaagaaaccaacttccaattggattcatcaaattcagggaagtgacggtcaccctcaaactcgtgatgaattttcgtcatatacagtctgtccgcataagggaaaaggtccgtatagagctgagcccctccgatcacaaagcattcttcagggcctgaacaaatgtccagtacatcctttaatgaaccgacaaccgtgcatcccggaaattctgaagccggcgctgaggtaacgacaatatttttccgatttggaagcggacgtccgatcgattcaaatgtttttcggcccataatgattgaatggcccgatgttactttcttaaagtatgcaagatcattgggcaaatgccacggcaaatcattgtctttgccgataagcctgttggcatccatcgcaaaaatgaatgaaatcatacgcttaccgccccttttatatgaggatgcggatcataatcctcgatgataaagtcctcaaatgcaaagttaaaaatagaatcaacctttctggcgaaacgaagctgcggaagcggtctaacatctctttcaagctgcaaattgacttgttcaatatgattttgatagatatgaacatcaccaaatgtatggatgaactcgcccgattcaagcccagtcacatgagcaatcatcatggttagcagggcataagatgcaatattaaacggcacacctaagaaaacatcggcagagcgctgatacaactgacaggacagcttgccgtcagacacatagaattggaacaggcaatggcacggcggcaacgccattttatcaatttcaccaacattccaggcgctgacgattaagcgtctggagttcggatttgtcttaatatcttcaataagacgggaaatttgatcaatggtttctccatcagctccccgccaagaacgccattgggagccatatacaggtccaagttcaccgttttcatcagcccactcattccagattcgcactccgttttcctgcagatagcgtacattcgtatctccttttaagaaccacagcagttcatgcgcaattgatttaaagtggagttttttagtggtgagcatcggaaagccttcccgtaaattaaatctcatttgatatccgaaagtgctgattgttccggtccctgtccggtcttcctttttctcaccatgctctaaaacatgtctgcataaatccttatactgtttcatttttttcatcctttaaaagtagtcttctagtagtgtaacacaataaaaaatcatttctgaacccagaaatgatttttttatagtcagctgacaacaggcttttcatcctgttctttttcttcatcttgcagatcctgatgcgtatgtgcaattctgctcgccgctgctgcagcaagagctgccacaatatcatccaaaaaggtgtgaataccgtctggactttcatcaagttccttaataattccaatcttctctttatccaaataaccgaaattggtcaaaccgatcgacccgtacacattaacgattgaaagcggaataatttcatctatgccgtaaagcggttcatctgtttcaacaaggtgctgcagcggctcggggagaagcttctgttctgcaagctgatcgagtgcaaggcctgtcaaaacagcatgaataatttcacgtttgttcaggactttttctacattctccatgcaaacactgagcggcagatttggattgtatttttcctgaagtttttgaacaatccgtgcaatatcttctatcataacgccccgtttgttcagcatatcctttgttatatcgaccatttcattcattgtgtactttttcatgtctaatggcatctcctttaggcactcatccagttgggaggcgtgttgcggtcccaataaatgctcccaagctcatgatgtgattgaaatccatcttctgctgtatgataatgaaaattaaaccagtagccgtcatgaggcgggtggtctcttcgcacatggaatctgagaagatcttctccagttgtccgattgtaaacgttgaaaattttttccgttttgcccgctgaaggcatgcttgagatcacaacatcttggtacgcctcatcatcttgcaatgtcgctaaataatcactaatcacattttcgatttttggcaggatctctttccgatagtcatcctcaatgacaggagcgattctgctgccgaattttaaaaaggactgatcctcagcgctgtcaaggagctgttccttgtacgattgaaaaagcagttcaggattttgcctgtcatccgactcatcatcgtacaggtcatgctcatcataaaaagcggtgtaatcattctgctcaagactgctcggctgtccggaaggcttgtccgccataagggcagccggaggagatacgagcccgaacgttacaatggtaaataaaaccacaagggtctttctcatccacaatttcatgactgcttattcctctctattttattgtcatgtttctcttattttagcacatccaaaacatgcaagtcatgtactatatgaaactgatatgcaaattaggagattcgttgctatgcactttgtgtaaaaacgcttacaatattccatgaaaggaggctttccgcatgattgacgctctgtttgccacagtttcactcttaacattattatactttgtcgtcatggaggtcaccgattaacagaaagcccgtgatatgaatcacgggcttgtttgaatgacgccataatggaacagtgctgtttttcttttcatgacgttaaaaccaaactgttcaaaccgcggacttttccagtggtcttttagcacaacgctttttctggcgactcgtaccgcttcattgatacatccttcgtgtaaaactgaatcctctgccaaatcacgtaaaggcgcgatgccgtcagaggtctctacaggttcatgaaacattggatcgaaataaaccacatcaacagagttgtcaggaagctgtttgatgtattctaagcaatcaccattcttcacctggattcttctcatcgcagcttgaagctcttctatacccgtttcccatgaatgcagccccgtcctcactaaaacagacacaagatggtttttttcaatcccaacaacagaacccgtttcgcctactgccatacttgcgataatggcatctgaccccagcccgagtgtgcaatctaaaaacgtatccccttcagataatccggcagcccgaagcataggctcttgctctccctgtaagaagcgtttggctctaaacatcgctgtattcggatgaaaaaagaatttggcaccttgtttcgtatacagctcaaaccgctctttgccgaccacaagcaaatcacgttcagctgacctcagcaggtgttcaaccgtttgtttattccggccgcagtatggcatatttagctctttagaaagctgctttgcggtttttatggtgtgttcagacggtctatagcttgttgttatcatcttctatactcccaaaaagaaaatgcccggaaaacgggcatttagcagtgcgcatcgaaggcagcagtcagatttttcatgatttcttccatatcgtgtccttcaatttcatgacgcggaataaaatgtacgacttctttgcctttcaaaagagccattgatggtgaagaaggctcctggccagtaaaatactcacgcattttcgcagtagcttctttatcttggcccgcaaaaacagtcaccgtattgtcaggtgttttgtcattctggaggactgcctgtgtagccgcaggacgcgcaaggcctgccgcgcagccgcatacagagttaacgactacaagagttgtgccctctgccttttccataaagttttctacttcttctgctgttgttaactcttcaaaacctgctccagtcagctcgcggcgcatcggtaagacaagctggcgcatgtattcttcataagccattgacataaaaaaagccccctctagtatccttcatctgaagtaaaggatactatagagagggccggatttcaaatgttcacgccttaaaatatagaagtaagtgtccccagctgtctagattttcataataccgccggtgttggcacttgtcacaagtttagaataacgtgccaggtagccggttttcactttcggttcaaaacctttccagttcgcttttcgtttttcccactcttcttctggcacttgtacatccaagatacgtttttcaatatcaacgataatatggtctccgttttcaacaaaggcaagtggcccgccctcagcggcctcaggtgatacgtggccgattgagaggccacgggaggctccggaaaaacgtccgtccgtaatcaatgccacttttggtccgagtcccattccaacgatttgggatgttggcgccagcatttccggcatgccaggtccgccttttggcccttcgtatctgataatgacaacgtcgccttcttttacttttcggttgataatgccgtcaagcgcctcgtcctgagaatcgaatacgacagccggcccttcgtgtcttgtaatcccattctgtacgccgcctgttttaatgatagcgccgtccggagctagattaccgaataaaacagcaaggcctcccttttcagtgaatggttgatccagcgggtgaatgacgtcataatcctttacttcatgtccggcaatggtttctccaagagtttttcctgtaacagtcagcgcgtctaaatgaagcgctccttctttcttggaaagctcattcagagccgctgacacgccgcccgcttcatgaagatcttcaataaacacatccgatgcaggcgccagcttggccaagtgcggcacgcgctcagcgacttcgttaatgcgttctaaagagtattcaacgccggcttcgtttgcaagggcaagggtatgaagaacggtatttgtagaacctccgagcgccatatcgagtgcaaacgcgttatcaatcgcttttactgtaacgatatcacgcggtttgatatctttgcgaatcgtttccattaattgcgcagccgattttcttacaaactctttgcgttccggagatgtcgccagaatggttccattacccggcaaagcaagaccaagtgcttctgacagacagttcattgagttcgccgtaaacatgcctgagcaagatccgcacgttgggcatccgaactgctctagttcttgaagctcgttttcgttgattttccctgcttggtaggcgcctaccccttcgaatactgaggaaagggagatttttcgcccgtcacttgttcttcctgccgccatcggtccaccgctgacaaaaatcgtcggaatgttgatgcgcattgccgccataagcattcccggtgtgattttgtcgcagttcggaatacagaccattccgtcaaaccagtgtgcggatacaaccgtttccacagagtctgcgataatttcacggcttggcagcgaatatctcataccgatatgccccattgcgatgccatcatctaccccaatggtattaaattcaaacggcacgccccctgcttctctgattgcttcttttacgattttcccaaactcctgcaagtgaacatgaccgggaacgatatcaatgtatgaattacacaccgcaataaacggcttgccgaaatcctcttcttttactcctgctgcacgaagcaaactgcggtgcggagctctatcgattccttgtgtgatcatattactgcgtaattctgccatggtgatcctcctaaattctttcaattgtttgattggattttattttgaaaattttcagtttatttatgagctgtttttgcaaataagataaattcaggccgccctcaccttgttttgttctttcgtgtttttatatttatatagcttttctttcgatttgaaccctccaactattaatattgttacttactataaatagttttcggatatttttcaacaatattcgaaataatttttataaaaagtgaattcacataaaaaaggtgcatgatctgcaccttttttatttctattcgcctttttttctgctttccgtcatttgtttccaaacagaaccttttgcttcttctccatgctcaatacgttcaagcgccattttgacttgaaggctgacctcaaattcggggtcatcttcggcagcgcgcaaagcttcaattgcactatcatccccgacttcgtacaggaacatggccgcacgccagcgaacaagcttgctggagtcgcttaacgacttgatcatagcgggaatggcttgaggatcgccgatatcagacaggcagtctccggccgttcttctgactgatacagctttgtcctcaagtgctttatacaatagaggcagaacatcaggtgtttcaatcattcctaagtacacaacagcctgtcttctgatggacacctttggatcatccaatgccttctgtaaaaccgggatatcctcttctttcggatccatctgttccaagtgtgcataacgctttttccagtcctcatcatccagcatgtcaagcgttactttatacgctttgcgctgtacagcttgttttgcttcgccctttccttgagcggctgcttcagtcagtcgtttcagccgttcatcactgtatgccgcctgaagctcttctgtcacgtcatggccgatttcattaaagtcaccgaacctgacaccttgttctttccaagcccgctcaaacacaacatttgaagcttcagatctaagttttaagatcgcctgctgaaagcgttcaggtaagccgaagcgttcttcccgctccccatcggttaatttaacttgcataggaatgccgctgaacatctgcacaaaaacttttacctctccaaaagattcttgatcagaacgattttcttctgcgctttcagcactttccatcccaaatgcagtgcggacttgcggtaaaatgtctttccagtcgtatcttgcattccgttcaacagcaagaaaatctgcgacgtgatatacccctttaactccatctattttaaggatttccgctataacaggcggtgcgccttctgcttgctcaggtttatagttattgcttttgcccgccggaagctcttccgttaagatgactttcattgtattcgggcttggtgtaggttcaattgattttatcttcatgatcgtcctcctatagcatatctgtgacttattctatcatagtcgctccaagccttctattacgacgttttggcatcaatcccggatatttctttttctaattggcggacaaactgaagcataaaattgtgtctttcttctgccagttcccgtgcagtgtctgtattcatcatatctttcagccgcagcagcttatgaaaaaaatgagcgtaggcgctttgatcatctccataaaggctatgcccgtttgcgcccgcaaacatgaaagctctcgcaatgccgacagcaccaatcgcatcaagtctgtcagcatcctgtacggcttttccctcaattgagagcggctccttcgccagcttttccctgtctcgaaaggacatccttgttataatatgaatcaccctgtcagcattctcttttcctactccgaaaaaaacgagctggtcatatacttcgttcacagaaagcctgaccgtgtcaggcagcttcacatcaattaaatcatgaaccaaagccgcggtttcaacaatgaacaaatccgctttttccttttctccaatatacgctgcaagatctgctactcttgatacatgatgccagtcatgtccagagctttcgtcagtcaggatagattgaacccatgtcctgatttgctctgcctgcttcaattccttcacaaaaacaccctctttattgctctaatagcttcacgatagcgtcttccagctctttcggatttgtatttggtgaataacggccaacgatttctccatttctatccactataaatttcgtgaaattccacttgatcgccttagttcccagcatccctttcgcatgttctgtcaaatacacaaacagcgggtgggcatttttcccgtttacatccacttttgaaaacataggaaatgtaacaccgtaatttgtttcacaaaattcctgtatgtcagcctcttcaccaggctcttggttcatgaattgattgcaggggaaccctaagatctccagcccctcctgctgatatgtatcatataattcctgcagctgctttaattggggagtaaaaccgcacttacttgctgtattcacgatcatcagtacctttcccgcgaaaggctgaagtgtcatgtctttccctgttattgtacgtacctttatttgataaatagacatgtaagtccctcctatgtccttggtgctgattattttaccttttttaaatcgcaattcaaaatgtaaacatcatttaagaactcataagtaatttgacgatatgagcgtccgttcattatcaattcatatggctcattttttatcttatcattctataaaacattacaattccctctgacatcatggaaaatcattttactgtgaaaccaaaaggcgtgtcagtgcgttttatttaaagagttttctgttgtttcccctcaacacgcatagatagattgaaaattggcgtgaaaattcctataatgaagaaaattaaacggggaaataatggaggtggcacgttgcctattaatataccaacacacctgccggcaaaacaggtgcttgaaagtgaacatatatttgtaatggatgaaagcagagcatttcatcaggatatccggccgcaaaaaattattatattaaatttgatgccgaaaaaaatccaaacagagactcagcttctcagattgcttggaaattcgcctttacaggttcatttcacatttttaatcccaagcacacacacgccgaaaaatactgcgagagaacaccttgacgaattttacacgactttttccaatatccgtcacaagaggtttgacggcatgattatcaccggtgcgccgatcgagcatttggcgtttgaagaggtttcatattgggaagagctcaaggaaatcatggagtggagcaaaacaaatgtcacttcaaccttgcatatttgctggggtgctcaagcaggtttgtactaccattacggtgttgaaaaaattcaaatgccgaaaaaaatcttcggtgtgttcgaacataccgttctttcaaaacacgaaagattggtaagaggttttgacgagctatactacgtgccgcattcccggcatacagatataaatatggaacagcttcaagcagtgcccgatttaaacattcttaccgcatcaaaggaagccggggtttgcttaattgtgtcaaaagacgaaaaacaagtctttttgacagggcaccctgaatatgatacaaatacgcttcttcaagagtatgaaagagatttggaacgaaacctttctactgtcgaggagcctaaacattattttgcaaaaggcagcaacgagccagtgaatcgctggaaagcgcatgccacattattgtttatgaattggctgaattattacgtttaccaagaaactccttatgaatgggactaatttttctttttttagtgatacgctgagcaaaaaatatgataaaatacatctgattcagtctgcgtataacaaaaatttaaaatactggaatccaaatcatttaaaattagcttaactttttcactgcattaataattcgattatgtatttgtgttatgtttatgtatagacaataactccttacgatgcatgaagcttgcttgttgttgattacattgaggtgaatttacttgaataccaataaaagagtattaattttgactgcaaattacggaaatggacatgtgcaggtagccaaaacactttatgaacaatgtgtacggctcggctttcagcatgtaacagtttctaatttgtaccaagagtcaaatccgattgtttcagaggtaactcaatacctttatttaaaaagcttctcaatcgggaaacagttttatcgtttgttttattacggagttgacaaaatctataataaacgtaaattcaatatttactttaaaatgggtaataaaagattgggcgaacttgtcgatgaacatcagcccgatattattattaatacatttccgatgatcgtcgtgccggaatacagacgccgaactggaagagtcattcctaccttcaacgttatgactgatttttgtcttcataaaatttgggttcacgaaaacgtggataaatattatgtggcaacagattacgtgaaggaaaaactgctggagatcggcactcatccaagcaatgtaaaaatcacaggaattccaatcaggccgcaatttgaagaatccatgccggttggcccgatatataaaaagtacaatctttcaccaaacaaaaaagtgcttctgatcatggcaggtgctcacggtgtattaaagaacgtaaaagagctgtgcgaaaaccttgtcaaggatgaccaagtgcaagtggttgtcgtgtgcgggaaaaatacggctttaaaagaatctttgagtgcgcttgaggcggaaaatggtgacaaattaaaagttctgggctatgtggagcgcattgatgagctatttcggatcacagattgcatgattaccaagcccggcggcattactttgacagaagccacagccattggagtgcctgtcattctgtacaaacccgtgcctggccaggaaaaagaaaatgcaaacttctttgaagaccgcggagctgccatcgttgtgaaccgtcatgaagagattctcgaatcagtcacttcccttcttgcagatgaagataccttgcatcgcatgaagaaaaacattaaggaccttcatttagcaaactcctctgaagtgattttagaggatatcctgaaggaatcagaaatgatgactgccaaacaaaaagccaaagtgctatcgtaatggcgtacttgagagcatacgaaaatcgtgtgctctttttatttatattcagccatcaataaaagcggttacatttttttatggaacttgcccttcttttgaaaaataagccgtttcgcaacttgacgggtgctcccagatggtgtatagttgaaccatcatttaacaatgaatcaaagttaaatgatgacaaaattttttttagcacatgggtgctacagtactaggaggaattaagcaatatgcaaaacggtaaagtaaaatggttcaacaacgaaaaaggattcggcttcattgaagttgaaggcggagacgatgtatttgttcacttcacagctatcgaaggagaaggatacaaatcattagaagaaggacaagaagtttcttttgaaattgtcgaaggtaatcgtggacctcaagcttctaatgttgtaaaactctaaactcaatacatgatgatgagatgacaaatagaggagaggcattcgcctctcctatttgattttcatctggatttcaatcgccaaaatgttttgtttgcacctctgttcaatctcttcaacatacttttccattgacggttttccttttttcgcgatatccgccagttcttctaaatcactgtatatttctataaatgttttgtgaaggatcaacttcaagtctttatcatccatagctgcgttccccttctctatcaagatacctcaaatagtaaaacagtcctatttattctggttcaatagttatatcggcttatttttattttcttttctattttggtacataaatttcaaaaaaactctgcaaaataatggcggaggtgtttttggtgacttcagaatttcataaagaggatcagactggctttacggataagcggcagctggaactagcggtggaaacagcgcagaaaacaacaggagctgcgacgagaggccaaagcaaaacattagttgactctgcataccaagccattgaggatgctagagaactgtcacaatctgaagagctggcagctctcgatgatcctgaatttgtaaagcagcaacagcagctgctagatgacagcgagcatcagctggatgaattcaaagaataaaaaccgcagcttctgcggtttttatttttagtgattggttaagacatctccgtattgtttcagcttttcaccaaccgtacatttattgatacaaaatgaatgcgcataagttttgccaaattctttgcgaaactgcttcttaataaaacagtccttgcaatattcatcgtgcagttctgtcagttctttaaagatcattttcttatccaatatcgtcatctccgttacggtctaatttcgtgtggctttctacgaattgatgggatagaatttttttagcgaggccgtcagcttcctgattgtcttttcgttgtattgtttcgtaggttggagtaagcttcagcgattcaaggagtgcttctattttgtcgagccattcattatgagatggatcataacaaggccagctgccgtcaagctgattcagcacaacaagcgagtcccctttgattgtaattgaatttctgcttgccccaagctctcttacttctcttattgcttcataaagcgctgcgtattcagcttcattattggttttcagccggaagcttttattttttctcaaacgatgccggattcctcccaatgaataatagatgacgatcccgagaccggccagttcgctctccttatcgaaactgccgtcaaaataaacagtaatgtcatcaggctcttgagcaagctcctctgtcagcttttccaattccttcagcgtccagctgccgcctttctcgtcttcgaactctagctctttcatgtatggaaaacggccaagttctctggcgagcatacgtgcctgctgtgctgtcagccagtcttcgctaaaaaatgagacggatcccgttccttttgcttctattttcaaatgcggtctgagcttcattacaatcaccttaccattcattagttgccgggcttatgctataatcaaaccaatcttaccccggaaaggaagctttttcatcttgtttaataattcgttttggatcttttttgcgatcattcattttatcattgttcttttattttataaaggatttggcaaaatgggactgtttgtttggatcggttttgcgacagtctgcgccaacctccaagtcgtcaaaacagttgaactgtttggcttaacagcgacactcgggaatgtgatgtatggcacaatcttttttgcgacagatgtgctgaatgaaaaatacggaccagctgaagccagaaaagcggtatggctcggattctcaacgctcctgacgctgacatttgtcatgcagggtgtgctgcttttcgaaccggcttccagcgacatatcacaaacagcgctggaaacgatcttcggattccttccgcgagttgcgttaggaagtctgcttgcctttatcttcagccaaacgctggatgtttatgtatattcggcaattagaaggatatttccttctgatcggcttttatggctcagaaacggcggcagtacagcagtcagccagctgtttgatacattcatattcactgcagtcgcctttctcggcatttatccggcaggcgtgtggcttcatatttttatttctacatatttgattaagtttgcggtatctttgatttcattgccttatgcttatgcagccaaaaaaatgatacctaaagatgaaaggagttcataatgcctacagaaatatacgtagacggcgcaagcgctggtaatcccgggccttcgggtattggcatttttatcaaacatgagggaacagcagaatccttctctattccaatcggagtgcatacaaatcaggaagcggaatttcttgcattaattgaagggatgaagctatgtgcaacgcgcgggtatcaatcggtttcctttcgaaccgattcagatattgtggaacgcgccactgagcttgaaatggttaaaaataaaacgtttcaaccgttcgtagaagaaatcacccgattaaaagcggcattccctctttttttcatcaaatggataccgggcaagcaaaaccaaaaagccgatcttctggcaaaagaagcgattcggctgaatgaaaagaattaaatcttgatcattggttcatcctaatggcgaggtgaactaacatgaaaaagaaagataaaggccggctgaccggcggtgttactccgcaaggcgacctggaaggcaatacacataatgaccctaaaacagagcttgaggagagagcaaaaaaaagcaatacaaaacgctagagaggatctaaacgatctctctagcgttcagcttttcaagcatacgctcaattcctttgatttggtggcggcgaagcatgtcagccgcctgctccatttgcaaagtaaataaagcgtctttcagtgtgcaggccagcggcactgagcaatgaatttccgcaagcttcctcgacatctccaaatcgcttaaaccttgctgaatttttccctgctgtccttttggaagaagagaaagattttccaataaacggtcaatcgtttcgtattcacgaatcagtttgtaggctgttttttctccaatccctttgactccgggatagttatcactggaatctcccataagcgctttaatatcaatcaaagccttcggcattacgcctgtttcttcataaaaagtctcttttgtatagactttataatttccgattcctttttgaagcaaagcaacgcttactttatccgttaacagctgaagtaaatctctgtcccctgttacgaccgtaatgtccgcttcattcgcaaataaatcggcaagagtaccgatacagtcatccgcttcatagccggcaaagccaatattcatgattccaagctctgcggctgcttcctttgccaaatcaaactgcggaatcagctccacaggcggcgcgctgcggttggccttataatcttggaacaagtcatttcggtacgttttgctccccatgtcccagcagcagacgacgtgtgtcggctggaatgtttccacagctgtaatcaaatgctttaaaaagccgttgacgccgttcgtcggcaccccgctgtcatttatcataaagttgcgatgtacggctgtggcaaaaaaggcccggaataaaagagccatgccgtcaaccagcaatagtttattattattcatcaaataactcccttttctttcattccttctattttatcataaagcagcccaaaaataaaaaacagtatctctttaattagagatactgtttggatatttatcaatcgttgtgtcttttgttgctggcgatcagcttttcagcttcgcgtcctgcgtaagagtcaaaatgggtttgaaatccgtttttctttttggcattgttattcgcctgtgcatttctgtttccgagctttgttctgcccaacatgaatccccccttacgtcggatgcatatagtatatgcttccggcaggaggttcactcgcgacaggatcatccagcttacatgcggcttacgtattctctgaccatttcttttgatacaagccgtcttgtcgggacgatgccttttttagcgagctgattcatttgctcggtaatttcattaattgcatctgtagtataaggctcatcgtttctgcatttagcaacagcttcttcaatcgccaattcacgcatattttcaagacgcataaatgctttgatatgctcgtgctgttttgatgaatgtgctgaaattgctttatgtacctctgacattaatcgttcatctcgcttttttctatttagtctatcatgacttgaaatacaagccaactgaattttacatttttattgtattgtctgaatttttccaggagatgcacgcctggtacgctatttcaatctctttcgcatgttccccttccgcatatcctcttaaatatgtctctttttgatccgttatttgcgcgattgctttttcacccatatcttcctgtaagcgtctgaggtgagctgtgtaatgagagatcaggctttcttcttcattttttatccatgcctctgtgattttcgtaagtttcatccgtacagcttcgataaaggccgattttcctttctgctcaaaaaactgcttcggtgatttgacctcttttagttcctgctcaaaagcacgttcttctatttccggttcaacttccttcaactgtatgccgttcgaatgctgatcacccgcataaacggaaaaataaccgtcctcgtttaatgttttttgaaattgatccagccattcttcattgatatgccgttcgatgaaaccgctcatgcgaacatcaagcgttttgatttcctgaatatattcaaattgatattcatgtaaggctgttgtcatcgccttactgacgttctttttccaatccccgttttgcagcccgggatgaaatgccgattttaataaatcatttgcaaaatatgataatcgctgtgtaatgtgatatagctgctctcttgtatctttttttactttttcaatgatggtttctgagttccgccgtttctcgatatcggccgctgtccgctcaaatgacagcataaggcgctgtttctgcgcttccttctcttctcgggactgatgctgggattggtgaagctgaaaaacagtttcgcatagtttgtctgcctccgaactgagctgcgctgctgacgctttttttacatccacttcgataaaccggtctaagtgttttcttactttcgggaactgattataaaatgactccggttttcccaccagttcctccttacttgatacggtaaagagctgcggctcataaaccccttcttttacaagctctgcgctgacataatcggtcactgtttcgagttctgttttatcttttgcaaggtctgcagcattaataataaaaaacattttatccatgctgagcgattctttcacaagtccaagctttcgcaaaaatgaacggtctccttttgaaaaagagtgctgataataagtcatataaaaaaatgcatcggcatctttgatatattggaatgccagttctgtatgccgtttattcatgctgctcgcgccgggtgtatcaacgatcgtaatccctttttcagtgagcgggcatgtataatagaccgttacctcttttacagcacaggccgttgtttcctctgctacatacggctttaattcagatagcggaatcgttaatttcttctgttcctgtatatactgctgatacttctcgtatgcaagcaggaaattgctgatcaatttcacgtgttcttcctgcagcctgttttttttgactgccttttcccacttctctgtgaaggaacggcctgccggttcctttggtattccggtgagctgcaaaatttcagccgttatgtcatcctctgtcttaaacactacatccgctgttttgtttaagttgccattgattggcattgtgatcttgttaattgtcgctgtggttggcgttggtgaggatggcagcactctttcgccgacaagcgcattggcaaatgatgatttccccgagctgaagcctccaaaaagagcgagtgtaaatttccgttcctcaagccttttcaccctttcacgaaacgctgaagtttgctttaacaacatgctgcattcgcttaaaaggtcagacaaagtgtaaaagcgtttgatttggtcttgaagcggcatttcttgttccattttgatttctgatttcggcatcggctgcgccgtcagctggcttcggccttgtttctgctctggagccgccactcttgttttcttcgatttaaaccattctgtgtctatatgcatggggcatgcggactcttcttcccaaatggcccacaggcgatcggttttctctcgggcattattctctaaacgcgcctgttcttgaagaaagacaagtttttctgattcttggacgagcctgtctttaattgtttgcacatctttggaaacacgctctttcaccatagcggagagcacctttatgatgtctgcggcttctcttttcgcctctttccggatgagctctgccaagtcttttgtatattgcaatacatattcagaggaaaaggctgcaccatgcttgaccgcgcgttcaatgatgcttatatcaagcggtgtgcgataggcctgaatcagcttttcactttcagcggtatagacatcaaataccttggcgagtttatgaagcgtgtctatcatatgccaatccgcttcgggctctgttcgttttgccacatcagagaaaaaagcattccgccttttatctctttcctgtgcagttttcgctttagaaaagaaaaagccggttttaaaggaaggctcttgtgattctaaaaatgcagccgccaattcacgcatttcaaaaggcgtcaggtttgcgttttttaaaatacgattgatttcttcctgcatcctcgtctctgcctcagtcgtttgtttttcggcctcattcaattgatcacgcagcgattggaccagtccaatttggatattaagctgttcagcgaaactcggagcgcctgtttcgtctttcttcagcatttccgtatgttcctttagcagattacggactttttgttcggttaaagcctgcatattgctttttgattgctgttctattcttcttaactcttctctcaggacccccatctgattgaacgggtggtccggttctgttactgacgtaaaatagagcgcttcctttgaaatcccttcattgcaaagcatctcctctacctgcgctttatagtctccaaatttcgtctccgtctcatcatggcggtcaatttgattgacgataaaatacacattcggaatgctttcttttattgatctgagaaactttacattttcctcagcgtgcacgtgattatagtgaacgacgtaaaacagcgcatccgcttggtgaagaatagaagcagccgatagaaaatgagcatcatctgttgaatctatccctggagtatcaatatacgcaaccccggaatcgatctcagtatacctgtcaaaaatttcgacgctttcaatctgttccccgtctttacaatattgctgcaccttgtctttctggtaagccccttccagctcagcacacgctccgtctgttgtatgaagccgaactcgcttttccccgtttctgatcacaacaaggttagcgcttgtcggaatcgggcttgtcggcaaaatattctccattaacaggcagttcagcagtgacgattttcccgctgaataatgcccggtaaacgcgatataaacctcttcatcagccgcttttttcatgaccgcagccagtttagcagccctttgttcatcttgattctcaataaattgcttataaatttccccagttttatgcaaaagctcttttctgttttgatctgtcataagtctgaacccctttgtgccgtttcaattgtgaacctttttcgaaagatctgaattcattcccttttcattttacacaagaataaaccaaatttctttaggagaatagaaaaaagccgccattacggcagcttctataaaagaaaatctgcaacttttacaagttccagattcatcaaacagatttattagagattccttttaatacaaaaccaattaatacactatatgtacaaaccgctccaagcaaaaacagcattgtcatttgcttcaccatcctgattgagaatctttttcaaattcattttaacatagttgagaatgattttcaatcgctattttatgctgtattcctgtaatgctttgtcttctgcgcgaattctgacgcttaacaacacggcattgaaaatggaaaacagacacatggtgacgtatgcttgataaagcagcggaatcagcaaaatttcgagtataacaacggcatagtttggatgtttcatccatttatatggacctttttttacaagctctacacctggaacaacaaggattttcgtattccaatatgcccctaaggaacaaagcgcccaataccgtacgatctgtacgcttaaaatcactgcagcgataccgagccaccagctggacggctgtttattcatcagcagcacttcggcaattaaggacaggaaaaaaaggatatgcatcgtaatgatatatggatagtggctctcgccaaattcaattgctccttgcttctttaccttttgttcgttttgcctggccactgccatttctgctgctctttgaacaatgagaatggcgatcatcaaccaaaacatgagtcaagcccccttttcccagctgaataatagcaactctgatgagaagcccggccctaatgcgccaatcagtcctcgttcatcttcctttttatgtccgttctgcagatggtctttgatcacatacaagattgtggctgaagacatatttccgtgcttttgcaaaatgctttgcgcagatgaaagcttttctgacgacagcccgagacttttgatgtatgcatcgatcactttttttccgcctggatgcgccaaaaaaacactgatatcatggaatgacagcttatgtttgtccaaaaaaatctgtacatttgttttgagccatttttccaccaaggtcggaatgtctcgtgagaaaatgactttgaatccttgatcggtaaagtcccagcccatgacatcttctgattgtttcatcaaaacagattgggcgtccattatcttcggcgcaagcttcagctttgacatcctgcggtccgccttctctccgcataataaagctgcggcaatgccgtcaccaaaaagcgaggtgccgatcagattgcttttcgttttatcttccggctggaatgtcaggctgcacagctcggcagcaatgacaagcacaaaagcctcaggatacgctttgcagtattcggctgcacgcgcaagtccgctggctcctcctgcacagccaagcccccaaatcggaatccgcttcgtatatggagaaaacggaagttcattcataagccgcgcctcgatactcggtgtggaaagacctgtactggagacgaaaaaaacagcttccactttctcataaggaatggcttcttgaaaaaattccggatgagagaggcactcacgaacagccgctctgctgtgtttaagtgtttcttctatgtatatttgatttttttcttcaaagctgtgcccctctttataccattcaatcggcttaacaaactgtctcgaatggatttgcccgtttttaaaggaggataacagccggtcaatatccttaaaagaatgctgaaacatatagcgggcgaactcggccgctttctcttggtttacattatacgcaggaagacttgttccaatggataaaataaacgccatgcgatcacctctttgcatacattgtgccgcaacaatcttttttatatgcaaaaaaactccgccgcggcggagttagactgctgttttttgttcagcgaggtcagcttcttgttctatttttttagctttagaaaaaaagttatatacaatatttaagacgactgcagtaaagctgcccgccacaatgccattcgttgtaagcagcgttaaggcactcggaagctgtttgaaaatatccggcacaacggtcacaccgagccccaatcccactgagcaggcaacaatcagcagattttcctgtttcgcaaaatcaatgcggctgagcattttaatcccgtaagcgatcaccattccaaacatcgccaccattgcaccgcccaaaacagcggatggaataatggtcgtaaaagcagcgatctttggaaacagcccaaatgccattaggatcacacctgtgaccacaatgacggcattttttttgatccctgtgagctgaacaagcccgacattttgagagaatgccgtataaggaaaagcgttaaaaataccgcccagaagcacagccagtccttcagctcgatagcctttagacaaatctttctctgtcaaacggcggtttgtcaggtcacctaaagcaaagtaaacaccagttgactccacaaggctgacaattgcaacgatggacatcgtaatgataggcgctgcatgaaaagacggcgcgccgaagtaaaatggctgaatcatttgaacaactgccgcgtccgaaacattatcaaattgaacttttcccataaaatatgcgatgaaggtaccaatcaaaataccgatcaaaatcgagacggacttgataaagccttttgtaaaacggtatagaagcacaatgatactcaacacggtaaaagcaagcgcaaggttggagagatctccgaaatctgcacttccttctccgccggccatgttattcatggcaaccggcatcagtgtaataccgataatcgtaacaacagagcctgtcacgaccggcggaaaaaacgatacgagctttccaaagaaaaatgaaataagaatgacaagaatgcctgaagcgataatgctgccgtaaactgttgaaaccccatattcagatccaatcgctatcatcggcgatacagctgtaaaggtacagccaagcactaccggaagcccgatcccaaaaaatcggttgctccacacttgcagaagtgtagccacaccgcacataaaaatatcaattgatactaaataagtcagctgctcgacggtcagtcccattgcttttccgacaatcagaggaacaacaatggcgccggcatacatggcaagaacatgctgaatccctaaagacagcgttttgccgaatccacttctcatgaatgaacctcctgtacgaaggacacttttccttcttctaaagactgaattcttgccaaagattccactcgatagcccagtttcacaagttcatctcttcccggctgaaatgacttttcaataacaatgccaattcccgcaatagaagctcccgcttgcttcacaatcgacacaagcccgtgcgctgcctgtccatttgccaaaaaatcatcgataatcagcacatgatcctgatccgacagatgggtcccagacactgcgatttggctttctgtttgcttcgtaaaggaataaacagacgctgtcagcaagttgtcggtgagtgttaacgattgatgctttctcgcgaagacaactggcacacccagcttcaagcccgtcattacagcgggagcgatacctgatgattcgattgtcacaattttggtaataccgtcttttgcaaacctggacgcaaattcgtcaccaattctctgcataagcagcggatcaatttggtgattcaaaaaagaatccactttcaatacctgatcagataatacgatgccttcttcctctattttccgtttcagtgcttccatcctgtctacctccgttatgagaataaaaaaagcattgcccgctcaaataaagagcaagcaatgctgatatcacaaaaaaccgtacacgtgcggttccattgctcacccatagtcggacatttacggtgcccggtagaaacttgcgtgccatatccacgcgaatatatgagtgttcctattatattgtaataaattatatcaagattctaatctcttgcataggctgaaaataaaaattcccgaactttaattttgtttttttagatatcattcgtatttcaaggggattcgatataaaagagcctgacgacgcgccgccaggcttttgattatgacagatagagatttgaatatttgtttgataaataatcaattaaatagcgaacattcagctcttctcctgttgcatctttaataatgtctaacggctttttccgttttccgtgaatgtgcaccttttccgtcagccattgctttatcggatggaactctcctctttccaagagagcgtcaaattcagggagatcctcaagcattttttgtttcagctgagccgcatacatgtagccgagcgcataggatgggaagtagccgaaatctccacctgcccaatggacgtcctgtaaaatcccctctgcgtcggtctgcggtgtaatccctaaataatcctggtatttttgattccaaagcgacggcagatcttccacagacacttcattgctaaaaatcgctttttcaatttcataacggatgatgatatgaagaggatacgttaattcatccgcttcgaccctgataaatgaaggttttgattcattgattgcccggacaaaatcatccagggagatgtccttgaactgttcaggtgatgcttcttgaatcttctgatagtacggtgtccaaaaatgcttgttgcggccgataaaattctcgtaaaataatgattgcgattcatgaattcccattgatgcgccgtctgacaagttcgtgccactgagtgcttcatcaatattttgctcgtatatcgcgtgcccgcactcatgaatggtgccaaagatcgccgtccggaaatctttttcatcatatctcgtcgtgacccgaacgtctccccggttcagcgtagttgcaaacggatgaacggtttcatcaagtcttccgccatcaaaatcgtagccaagctcctgtaaaaaatacagactgagctctttttgcttttctttcgggaacgcttttgtaagaaagcttgtatctggtttatttccggaagctgtcacctgtttaacaagagggataatcgcttccttcagctcagcaaacagctgatcaagcacctttaccgtgacgccgggctcaaacaaatcaagcaatgcatcataaggatgctcttgatatccccaatacgtaataaaacgtttattgaattcaatcagctgttctaaataaggagaaaacaagctgaaatcagattttcctttcgcttcctcccacgctgtttctgcctttgaacacagaattacgtattctttgtattcagcctcagggattttcttattctcttcatactcttttttcgccagttccactgcttttttcgtatcttccgacaagtcatcaaatcgttcatacaggacatcgataagctccttcattcgatctgatgtttggatattgaatatatctgttgaaagctggccgatgctttcggcacgatcctctgagccgtttttcggcgcgcctgttctggagtcccagtgcattaacgcaactgcttcgctgtaatgtgagattctttttaaaagatcaaaaaattctttttcatatgtatgtatctccatatccattccctccctattctagccgttccattacaggctaatggaagggggtatgaaagtcaaattgtttgtataaaaggctgccggtatgttttgcggcagcctttttattcagttgatcgtcatttgattttttggcggaggtgttcttcgctttttctgcttgatttttttatccacccacactgttgccagcggggttaagagcgaggtgacaataacgcttgtcgctataattgcagttgccgactcagcaactggcgcaaatgaggcattcgcttccgctaatgcgtatggcacggctacagccgcccctgccgtagaagaagcggccacacccgcgacaccgtctccccgcgcgacaaaacgatcaagtaaaaacaaggaactgcccgataaaatgacgacagaaactccgataaaaatgccgagcagccctgattggatcagcattccaaaattcaaggtattgccgagcgaaaaggcgaaaaatggaatgatcgccggcacaaccttgctgaataagtctctgagatcgtgatccagatttccaagtatacatccaagtaaaaacgggataactgtcgctgccagcgtttcccatgggaatgcggcaagtcccgtcacaccaaacgtcaccatggtcataaaaggaccagattctgtactgataaaggcgaaagcgcccgcatcctcttttcttcccatgtgattcatgagcgccaaatacagtccgccgttcgtttcattcattaccgcgacaattgctaaaacagaaaggcctgcaaaaaagccggattgtatgccttcgtcaggtataaattgcgctgcgatcacgccgagcagtgccgcaaatccgacctttcccaataataacgtgattccttttcttgcgatatagcctgaagaacgaaaatcaatcgttgctcctacgcaaaagataaaaacacccagtattggcagcgttccggtaatcaaagcacccgtaaaccctccaaagaactccgctgttccaggcgcaaacgtgttgagcgccgctccaagaaatagcggaataatcatcattcccccaggtacccgttcaattgtcgccttgattttcatattgtggattctcccatcctccggttatgaaaaaacaatttcacttacacttggaaaacagcctgcaaatcctcttttgaacagctgcccagctggctgccgactccgacggcgccagctccggctctaagccaatccggcacttcagacggatgtatcccgcctgtcggaataaaggtcacctgcgggaaaggacccgctaaatttttcataaacgggatgccaaacacaccgcttgggaacagctttaatgtcgtaaaaccgaatgtcagcgcttccataatttcgctcggagtcaagacgccggggatataatgtgtctttacaaaagatagatgttcagcaagatcagctgaaaaacccggactgacaataaactgcgcgccagcctcagcagcttccccagcttgctgcgcggtgatgaccgtgcccgcgccaattaaaatatcttccctattacggaaggattcgataatatctgatgccccgggggtcgtatacgtcacttcaactgcacgaatccctttatctaacaaactctcaatctgctgacaggcctcctgcgtatcctttgaacgaatgactgcaatcagctttgcttctttcagacggttttcaacgactttggactccatattaataatcccctttcttttggtgaaccgttctttgagcagataaaaaagaagctaatttctccctggtcggcaaaccgtccatatcccccggtgcctgcacttgcaaagcgccaatcgcatttcccctttgcaccgcatccttgtacgacaaaccgtctaggataccgctgattacaccgactgcaaatccgtctccggcgccgaccgtatcaaccacccggtcgacccggcagccttctagaaatccttcacttgtccccgttttaaagtaagcgccttcttttccaagtttaatagcaacaaagctggcaccttttttcaaataatagtcggcaatgccttcaggtgttttttctccggtcaatagctctccctctgcgatacccgggaaaaaccagtctgcaagcccagccagatcattgattgtgtgtaccattgttgcttgatcaggccaaagcgaaggtcttacattagggtcgaatgaaatggtcttccctgcgtttctcatgtcgttcatgacatgatacgtgaagtctttcatctcggctgacaaggcaggcggaatgcctgtcacatgcaaatggcctgcgcattgaaaataatctctcggatattcagctgaagttaatgtgcttgcagctgagtttttcctatagtaggtaacttgcgggtcgccttctttcacttttgacttcagcagcagcccggtgggattttcgtcctgcgagcggatcacgcgggacacatccactccctcttttttaagttcctgtacaataaacgttccgagctgatcattgccgaccttgctcatccatcccattcgaaacccgagtctggcaaggccgcaggcgacattgctttctgctccggcaagccctttagaaaaagtggatacttcatgaaggcctccatactcatttgcataaaacatggccattgattccccgaatgtcaccgcatcaagcttcatctcttcccaacctcctcttagttgagggcacctaggattaaagtgactttctcatgatgacttttgcctctaattcaatggtttgaggcgctcctttgtcaccttcaatcctttttaatacacgttccatcgccgtcctgcccatatcatgtgacggctgggcgatcgttgtaatacctggaccgatcagtttataccattccgtatcatcgaatcctgcaatccctatatcttgagggatgcgcaggccaagctcttccatacagctgatgattttcagcataatcaagccattcaaagccagaatcgcttttttttgctccggcatttccttgtgaaaagaacgaagcgccgccttaagctgctccttgtcctttacgtcaatttcaagcaatctgacaagcccgttcacattatgaaccgaagccattttctgatacacagctgctctttctgcacgagggctgatagaggaaatcggttcggtaaacagcgcgacatcagtataccctttgctgtacaccttctgaagaatctcttttgtgatccatctgttgtcagtcgttacggtatccagtttcagatccggcagtttccggtcaattaagattgttggaatttgctgttcagcaaaagcgcgcagtacatccttgttttcccctgttgcgtttaaaatcaagccctcaaccgaatgggcttctagctttaagagcatttcccgctctttttcaggactgttatctgtgttgcacaccataatgctgtatccatattgatcacaaacctcttcgactcccctgaaagcagcgaccgaaaaaggatttgtaatgtcagctacaacaaatccgattaacttgcttttttttattttcaaaccttgcgccattttactcggccgataattcaattctgcaattgcctttttaatgtttttcactttttcaggagaaatcgcgtcaatttttccgttaatatagcgggaaactgtcgatttcgaaactcctgcacattcagctacatctttgatggttgtatggcctgttgttttctttttcattcaagtgctcctgtatctcttatatttgaaaccgatttcaaaaccgttacaacaaaagaataccataattttaaaatttgggaagagtttttttaataatgtgtcaattcattattttttcgttgactcttttcactatttatcctaaaattttctttgaaaccgttaccaaaatattttcattcaagtgatgctgaaatcctaaccaagggggaaatataatggaaaatcgttattctgtacatcctgaacaagtaaaacgctttacaacagaggagcttcgcagtcatttcttaatggatcctttatttacagaaaacaaacttacgatgtattactcacatgaagaccgggttgtcatcggcggagcggctccagggcaaagtgaactgaagcttgatgcaggtgattttctaaaaacagacttctttttggaacggcgtgaaatcgggattattaatgtcggccagcctggtgccgttagagtcggcgatgatgaatatgtgcttcaaacaaaggattttctctatatcggaatggataatcaggatgtatcattttcaagcctgaacggggaaaaagcgaagttttacttcgtctccgcttgcgcccacaaaagctatccgacacaaaaagccgccctagctgaactgacaccggaccgccttggtgatgatgcagcgtctaatgtcagaagtctgtacaaagtcattcatcaggatggcattaaaagctgtcagctgatgatgggaataacgatgttagatcaaaacaacaactggaataccatgccagcacacgttcatgaccgtcggatggaggcttatctttatctggatcttgaaaaggactcaaaggtatttcatttcatgggccagccggacgaaacacgccatcttgttgttggaaatgagcaggctgtcctttctcccgcctggtctattcattctggcgcaggaacatcaaactatagctttgtgtgggcgatggctggagaaaattacacatttacggacatggatctcgttccgatggatgggctgaaataagatgggttatctacatgacgccttttcattagaaggaaaaacagcgctggtgacaggccctggaacagggatcggtcaaggaattgccaaagccctagccggtgctggcgctgatattatcggcacatcacataaaagcagcctgtctgaaacacagcagcttgtggaacaggaaggccggatatttacatcttttacattggacatgagcaagccggaagcgataaaggattctgcagctgagctgtttgaaaacaggcagatcgacatccttgtcaataatgccggcattattcatcgggaaaaagcggcagattttccagaagagaactggcagcacgtactgaatgtcaatctacacagcctgtttattctgacacagcttgctggcaggcacatgctgaaaagaggtcatggaaagattattaatattgcctctctcctgtcttttcaaggcggcatcctcgttccggcttacaccgcgagcaaacacgctgttgccggtttgacaaaatcatttgcaaatgagtgggcagcgtcaggtattcaggtcaacgcaatcgccccaggctatatttctactgcgaatacaaagcctattcgggatgacgaaaagcgaaatgaggacattttaaagagaattcctgccggccgctggggccaagcggatgatatcggggggactgcagtctttttggcatcacgtgcttcagattatgtaaatggacatattttagcagttgatggcggctggctatcccgctgacaaataaaaaaagctgacgaacgatcgtcagcttttttccattacatcatgtgcggttcaacaggcaagacctttttgacctcatcaatgatgcgttcattttctccgccagcgtaaatgtgaattgagccgctgtcttgattcgaacgaatcaggcgcccgatgccctgccgtacacgtaacaacatatatggcagatcaacttcttcgaacggatcttttttcgctccgttgcgcttcgctgtaaatacaggatcgtgtggcggaaatggcaatgaccaaatggtaacattcttcaatgcgtcaccgggaatgtcgagtccttcccataagtgaactgaacaaagtactgtttcctcttcctcttggaatttctctactaagctgctgatttcctcatcaccttcgaagaaaattggatacggcagctcccatgccgccgacagctctttaaactcgtttaattcttcaaaagaagggaaaagcaccagcgttcttcctttgtaacgtttgattgtttcaatcgtttcagccgttttttgttcagcggccatatctgtttttgcgtatagattaatactcatttgctcgtcataatcataaggggaatcaacagttaatgacaaataatcatgaatcccaagactgtcggcaatataatcaaacgaaccgccttctgacagcgtagcagaagagaagatataaggaattttcttagaaaacactttttcgccaagtacttctgctaccgttctcggcatcacgacaaaggttgattctgcttcctttttctccagccagctgatcgcatccttttgatatagagataatgaatacgccatttgttcaacatattcttccactactgacagttcgtattgatcaatcgtatacatttcagactcaaatacaagtgcctcaccgattttatcaagtaaacggcaaagctcgtccgccgcctttttgacacgatggtcattttttatttctaaacggtgtgaaccggctacttcctttgattcttcagaaagaacatagaaaaattcgtcgtttgcgagaagcgcatcttcaatcaattctgcaaactcttctctgatgtcattttgcagcaatcgttctaaaaacaattcaagagtagactgcttcactctataggttagcgctttttgcgcagcaaactctaacaagtgcccctcatcaaatacaactgcactatgatcaggcaagagcggcagctggccctctcgtttgcgtgattcttccgtccacacatgctccatataaaaatcatgggaacatatgattaagtccgttgacttgcgatagtaatctctggaaagtgtcagaccgcatctgtgtctcatatcacaagtcagacagtcctgaaacgagtcgtagcttacgtcagaccactcttcattcgatagatttgcgtactgcttacggtcgccatacggataaaagcgctgcatcgcctgtgactcgtggacaaatgacggtaacgactcataaagatccagccatttatcatcatcagaacgctgcattgttttttcaagcttcttcaagcataaatattgctcatgcgattttgacagccttgtatcaattttcagatcaagatgctcagccagcttagaaatatcgccctcttttttcactagctgttcaattaatgtttcatctgcacaagcgatgatggcgggtttgccgacataccttgcatagctgattgcaaaaagaagatataccagcgttttccccgttcccactccagcttcggcgaacatgacttttttctctttaaacgcccgctccagctgaaaagccataaatacttgctcgtcccgaagatcaaaccctttttcgggaaggatatcgtaaaacacgtcaccaatccaattgttcaattcttcataaaaattctttgttttcgttaaagaaaaaggcaaacgtgatgttgtcacctagttccaacccccaactattcgacattcagaccaccaataatatcattttccgctgatgaatacaataaaaaaacttggcaatgccaagttttttgcagtttacttacgattgatcacatgcgacgataaaaaaggatggtctgttgaataaatatgttctaccgctttttctaaattagtttgcgcatgcgaaatcatagacggagacgattcagtcccgagctccttcagctcgtttgctgttgcgtcaagcgccctttgaataagattaaaatgttcgctgttcagcatgagatcacctctgatggaaataatcatcattgtatgcgaacttttcattttatatacatgctttaccgcatgttatcaccgaaacatgcacaaactacacttgatattccgtctccggattatccgtcttatcaacaatattctatcagggagtgatgttgacatgagttatagaaaccgattagatcagcattctgaactgttccatcacaattggacgcggcctaaacgttctaagtctcaagtaaacggtcacactgaaatgtcccaaaccaacattatattgagaagcaacgcgaaagctcaccgttggtaacgatagaatagggctgaaagatgaaagaagacgcatgcagagcgtcttctttttatgcgttttctgttttcttgcgctgcggccttacttttgaccaatattgataataatccgttttaataaacccgttaaagagctttcgtttcttcgttgcttttctgccatatgcttcctcaaagttttcatttgatgtcagcatatacacagaccaagtatcaagcggctcgaacgccttccccatttctttgtacatctgctcaacggcttttttctcgccgagacgctctccatatggcgggttgccgacaattacgccaaattccagatttgtggtaaagtctttgacctgcatctgtttgaactggattagatctcccaatcctgcttcctctgcattttcttttgcgatttgaaccatgcggtggtctatgtcgctagcgaaaattgtaagcggctgatcataatttgccttttcttcgacttcaagccgcgctttgttccacagatctttaccgatccattcccaatcctctgaaacaaaatcgcgattgaatcccggggcgatgttttggccgattagcgccgcttctatcgcgattgttccggagccacagaaaggatcaacaaacgggcggtccggcgtccaattggttaattgcaccaaagcggcagcaagtgtttctttaatcggcgcaccgccctgatcgacacggtatcctcgtttgtgaaggcctgtccctgatgagtccagtgtaatcaaagcctgatctttcaataaagaaatttcgactttatactcggcacctgtttcttcaatccaatcattggctttgccggactgcagcttgagcttttcgacaattgcttttttgacgatccgctgacagtcgggaacgcttgcaagtgttgattttaccgattttccgataacagggaatttcccgttttcaggtataaatgagcgccagttaatcgctttcgttttttcaaacagttcatcaaatgttttcgctttaaaagaagcaacctgaacctttatacggtcggctgttctaagccaaaggttggcacggcagatggcaagtgcatcaccttcaaaaataactttcccgttatcaaccgtgcattcgtatcctaaatctcgtacttcctttgcgacaacagcttcaatgcccatcggcgccgttgcaattagtgtatacttcttcatcgtatcaccctgtcttttgaaacttttctcttttcaagataaaagctctccttatacgggagagcttgttttcatcattttaaatgtaagtggtctaacgttctgtaagccatgttttgttccgtcgtactgcaaacggctcatcacctcgtactcaggcggcaatcatctatctacagaaagcattctgtccttctctccgttgaattccgttaagaaggttcccctaccaaaatttgggtttctcgctcgaggggtttaccgcgttccactctcaccatttctagtgagacttcgtcactgtggcactttcaaggatactcagccatatccgaagacgtaggcttttttcctgccgtcagtctctaaagactgccctagcttatgacttcgctaggcacgaacactacgggcatctcagcaccgtgcgagcatggactttcctctacagattcaagatctgcagcgattacccgaacgttaagaacatgaattattatataacaactgtttacaatttacaagcgccatttttttcaagcgtgatcaatcataaagcttgctgccaaaaacgtgtttttctaagttagacagccgttttaaaatatcaaagtttgttgtgttagattgcacaggctgttttttgctggcttcttcaagctgttttttcagctgcagattttcctgctgcagttcttcaatttcttgatggaaggtttcataatccttaataatcatatctaaaaatttgtcaacgtcttcttgcttgtagcctctaacgcctgttttaaattctttttccaaaatttctttcgcagaaagctttactttatcagcaagcatctttttcacctcgtatcgtgaatcatcacatatattttttcagaaatctgtacggttgtcaaatttctctctcattgttagtagctgtcttcctccactgtcactctcaagtcatccattgtaataaagtagatgggatagccatcctgttcgcgccttttttccgctgtcccaagcatatacttaggggagccttccttttccgggtcatataaaagcagaagcccgtcggacttatcaatgaagaactgatttttttgtttgaattgaagcgggctttcataaggacggtgagtcaggcttgcttcatagtctgcctgagacagaactgcttcatactgttccttattcggttctttccagttcttttcctgctcgtaaaatggtgtgatgacagctacttttaagtcagggtattcctcctgcaaatcatatgcagcttctgccgcccacagctccgctccaagctggcccgaaattaaaatccattctaatccttcatccaaaaaagcaatcagccgattcttaatggctttttttatgtaatacagcgccttgtcatcctgcttaaatatcccgagttcaaacggtttatagcccgtaattgccagtactttcatcatttcacctgctttaaaaaatggggctcccgtgggccccatttgttgtgctgcattgtttacaccatcaagctgcacgttttccatactagtagtcgcagcaaggttttcctgcttgaaaatgctgatgcgtagccgggtcaacatttgagaaagtgtgtggaaagtagtgaacgtgctgaaaatgctggtggtttacgtttgttgtatgctgtgggtgaatgtgcggcacgatagtcttcgaaaacgtatggtgttcacagcaatgagtaggatggacaattggcgccatcatatgcggtctgcagtgatgcatgataaaatcccctttccataaactttattacaatactaagctatgaaaaataaggggtacatgttctgatgcaaagacctattttaaaagtgtgcaattaagctgtctttaaagtttgaaaacacaaaagcaatcaaaaataccacaacaaagaacaagtaaaaaacacccttatacataccaactctccctttaaaaataactaacgtcattttacaggattcgccgctattctacaacaaaatcaatgtgaattcagcaaaaaaaattcatggcgaaacaagtcgtcttttgcgctttcccggggaatatttaagaggaatatttcctcttcagccgggcaattctcacatgcagtttttcagtttctttctctgataagcatgccgcatcgctaagcaattgctctgctatttgcaatgcttttccggattcttttttcttatgctcaaaatatttcgcgagctctattacagcagcgtatctgcacttctggttttgcgagcgggacagcttttcccaaagcggcactgcttcttccaagcggttttgttttttgtacaggagcgataaatccagccgtgcactgtcctggtcctcaaacgatttttctataagcctttccaactgcttgatcgcttggtccgtttctttatgagccataaaccatttcgccatagcataggcttcactgtgttcttttggcgcatgtgattctgaaaggatttttttagacatatggatgtacaatgaaatgagtgataacacatccatttcattatgatgcaggacaccttttaaaagatccggctcttgcgccttgataaaatgaaagtaaagcattggcgccaagtagcccggtgtgtcttctagcctgcggatgccgagctcctctttttcaaccgtgccaagagatacacggtccattttgtgtttccacaggcgtctagctccatgcaaaagatcaaagtggccaaactccggaagcttcggaagtctgtcacggatcaaggtgtgccttgttttcacctgcggccaatcaaaggctttgccgttgtaggtcacaagtgatgtaatgtcaacctcgcttaaaaagctttggtacaaggcgacttcgttccccggtttgggcaaaagatgctgtttgactgtcactcggtcttcatatactctcgcatgcccaagcaaaaaaatggtattcccagctccacccccaagaccggttgtttctgtatcaaagaaaaagaggttgtttttgttatacccttttgctgacaatgtatgcgacaggccgctttgattccacagtgtgatcacttcttcaagctcagaaaagctgtataacccatggcggtgagaaagcggatattctacttctctgatgaggcaatattcatcttcgaagatgaaaggcttcatgccaaaagcctcccactcttctaaaaacgggatgtcatcaaagtggttttcttgtttgcctgcttctattttttgttctccttcgtcgagcgccatgtgctttttcatccgttggagtttcccttttaatgacatatccggcctccctccttacgacatttgatccaacagctgcaaaattctttcctttgcttttatcccttctatttccgtacctatacaagacggacagccgtcatgacaaggacaatgtgtaatcagttgtttcgccgcttcattaatgtctgaaaaacgtttaaagacttcctccgccaaaccgataccgcccggataatgatcatataaaaatatggttggcaatccggtatgggctgctttgatttgagaaacaacatgaacatcatttcgatcacacatgatatacacagggacaatatgctgcagcacattcgagatgccaagaagcagctgttccagtgtcttttccccgatgtcttcatccgctgttttgatttcgagccaagctgcacttgtatgcagttcttcttccggcaaatgaataggtccagacccaatattttcaaaagtggtcatttttatttttttaaaaatggtcggcagggcattgacagtgacgtctccgtagtgcaatgacgtacggcttttttctttcgttttatcgatttctaaaaccttcagctgaactgccaggtttgcatccgtataatattcgacatcgacttttctgacatacgcctttttatggtcccaatcgagcttctcaacttgatactgaacgccttcatgcaaataaatcgcttcatcatgcaaaagcgtcatcgcactaaaacggtccatttcaccgataatccttacatttgcaatatccgactgatcaactataacgacattttcctgggaggcggaacgcaaactgatgtttgaagcagggaacgactcacttgcccaatggtaccgttcgccgttgcggtgaagaacagcctcttcctcaagatactcaagaatatcactgacttccatgggtccaaattcttcatcagctctaaaaggaagctcataagccgcacactttaagtggtctactaaaataatcaaattctccggattgattcttgcagattcaggcgaacgattaaagaaatattcaggatgccgcacaatatattggtcaatcggtgttgaattggctaccatgataatcaaagattcaccgtgtcttctgccggctcgtcccgcctgctgccaagcacttgcaacacttccgggataccccgtcattacacacacttgcagctggccgatatcaacaccaagctctaaggcattcgtactgaccactcctaaaatgtcgccttctctcaggcctttttcgatttctcttcgctctttcggcagatagcctccccgatagcctctgattgattttgttccaatctcttttttcacaagctcctgaatatggcttaaaataatttccacccgaactctgcttctggcaaaaacaatggtctgcactttgtttttaaggaactctttcgccagttcattcacttctacggttgcgctccttctaatattcagcggtttgttcacaattggcggattgtaaaacacaaaatgcttgcgtccgctcggtgcgccgttgtcatcgaccagccgcatcggtttgcctgtcagctgctctcccaattcctttgggttggcaattgttgcggaagtacaaataaaaaccggatcacttccataaaaccggcagatccgctttagccgccggatcacatttgccacatggctgccgaacacacctcgatacgtatgaagctcatcgatgacgatatacttaaggttttcaaacaaactgacccatttcgtatgatgcggtagaatggcagaatgcagcatatcggggtttgtaatgacaatatgacctgcttttctcaccttttgtctgattgccggagacgtatccccgtcatatgtaaagcttttaatatcaatgcccatttcatcaataatttcatttagctcgctcttttggtcttgtgccagcgctttagtcggaaataaatataacgcccggtttgtttcatcttgggcgatggactgcaggactgggaggttgtagcataacgtttttcctgatgctgttggcgttacggtaacgatgctctctcctttttgcacatattgaaaagcggaatattggtgagtatatagttcatcaatgccccttttcgaaagggccgctttgattctctcgtctatactttcgggcataggccttgtttttgcttcccgaggctcaatttcatgccaattcacaacgttttcatttccttttaaatcagaaatgagttcagtcagtgatttctttttcattctttacacctctttgtcaagtacagtttaccgaatatttgtttgcatggctaggtgcaaattttatacagttgaataaaaaaagcaaggcatacgccctgcttatttcgctttgattgtaaggagctttgattcgcctttacgagcagccttttcgcctgccggcaccattgatcctacagcctcaccattcattataacgattgggatgactgtgctgctcgctttttcttttattaattccaaatcacatgtaatcagcgggtcaccgaccttcactttatccccttctttaatgtgggcagtaaatccttctccgttcatattgactgtctccagcccgacatgaattaacagctcaattcccgagcgagtccgaatgccaacggcgtgtttggtgtggaaaatctgaatgacttcaccttcagcgggagaaacgatttcaccgctagaaggttccacggctattccttctcccatcattttctgtgaaaaaacagggtccggcacatctgacaggtccattactgtaccgtctgccggagaataaataacctcttctgtcaccttttcctgagttttgcccattccgaataattttttcagcaatgtattttctcccttctcattcttcaaccgttatcccttcattcaccactatttaaccacactttcaattttgcttcaatttataacaacatctggcatagacgcataatctggttaaaaaaggcggtggcgaaattggaattctatgatgacaaaaagaacgaactgcaaaagaaagaagaaatcataacggaggcaatcgacactctttttcaatcctcagcgttcggcaaccttataaacggatttcagaacctaatcaactcgagtttaaaggatgtgcagacgaccatacatgtcagagaaagagatactgggctgtatatcgatattaccattccggcgacgtttcgagatggcgagatcgtcgttgatgttaaatcgaggtatctccatgtaacactccaagaaaaacagaaacaccaaaatgaggctacctttacaagcatgacaagaacggttcagctgccttatgaagttcgccaagaagatatggaaacgtcttggaacgagcagacaatgacacttttctttccaaaaaataagcatgaatgaacgattcattcatgcttctatcatttaaaaaagctggtaaatccctttattaaagatccgacctgattcattgcactcattacttgacctgtcgtatccatcattttattaaaatcaaattgcccatttgcttttttgaactgcgacataatgctttgaaattgcgaaggctgctgttgattaggccttgggataggataagggttagaaaatacaggcggctgcataggcataggctggatcggagcataaggctgataataatcctgctgtccataatgctgctgaggcagttgttgctctaaataaccgggtgcagcctgctgataatatccttgcatatgctgaggataataatagcccatttgccgaggatagcttcgagagctcccgttcattgcgattcccccctaaacacaacatatttctcttctatatatgtatgaatgacttctattgtttgtgtcacaagtgatgattagcatttgtcaaattgtgtcgaaagtttaaattttttaaaaacagaaaaaagtcgaatcattatggtaccatattttcaatacagatgagaggggatgcaccataatgaacgtatcatacttaagcaaacgttttgcagaaatgaagaaatatgaaacagactgtatgaataaactgatggactttgccaagttcctctatattcaaggacatctcagcataactgagtttcgtaacagtatgaaggttctcgaagcaaatggagcagaaagcccggcatatgagatgaattaacgtccggccccctataaaaacgaaaagaagacagccttttaccggctgtcttctcttgcaatttcatcctttactgcgtgcaatgtataaaggactgactcagtgatgtccttgaatcgttttttatgaatatgatgaacatatgattgaaggaccaattccaggaaattatcttttacggtctcaatttgctctttatgcacatattttggccggtgggcttttatcaattcaagagcaccctctgcccagcgggccgccagttcatcattctcttcaactgcaggctttatcatctcaaaaaaatcataagaatgattactgttttttccttcctgataccgatcagcgcctttttcagcaacttcaatcatttgctcggtcatttccagcaaagtttgtgatagcaatatctttcacctcaatgcctatcgtaccaaatttcactcgcaaattcagccgatgcggtataccttctcaaacgcatacctgtgttcaggcgattgatacagctcatttatacaaatatgaagatctatgatttcttcttccagcacactcaggcgatcattttccgtttcccgcatctcagcctctaatgcatttacagaatgattcaggctttgctcagctcgcgttaattcatcttctatatcagaaagcatacggagaatatctgtcttgcatacataaccggacattcgtgtacctccctttccttgtctctcccgcttaacattctttgctctcaaggctctttccttcctcatgacaaaactagaagcaaatcgccaaacaaacaggtattccacgaaaagctgaagttttcgacaaaaacacccgcaaaaattgtatgatcctcctccttaatgcaaacgatacttgtgaggaggtgccgtatgaaaacaagaccgaaaaaagccggccagcaaaaaaagactgaatcaaaggcaatcgattctttagataaaaaattaggcggcccgaaccgcccttctacgtaagaagcaaggaatttccttgcttctttattttttcagccactgctccaccgcaaaaagcgcatgaagctggcgctttttatgtaaataccagtctgtcaattcaatctgcttcggcaattcctcgcgcctaaagaacgttttctttatctttccatgaaaccaatctgttttcgttccgtctaatgagtggattaactcagggtagcatgtccttagcataggagatgttctttttgtaatcccgatcatcttttccatatcaaaacgggaacctgtgtgcggcactgtgtgcaaaaagtgataaaaagaggagaacaattctggcttgaacagcaattgagacagctgctttcccagccttatcctttcctccgcctttgaaaagcgtttcactgaaatgccgtaaaaaaacccatttgaggaaggaaaaataacggtgttaaaatgaaaccagtcacttaaataaaaaggaatcgtgtcaaaaacattctttttaaacgaaggattttgtataataggtgtttggatagtgttttgttcatttataatgagggcatacattagccgctccgtatttcgctcatgccaaaaacgggtccattcttccgacataaattgtgagacgccaaacacatgcagaagatgaaacagcggtttcccgactctttttgaccagtggtataaaagaagctgcggataggcatccgaaaaaataagccagttcgctctttcataggctaaaaagaaccatttttgctgtctctcacggagtccaagctgaaacagactgccttttaaatcagtcattgaccagcctgcattacgagaaacgaaagaagccaaaagcgaccatttgatttccggatgacggtcgtaaaatgctttataagcatttgttcttgaaatgttatccgcgttttttatttttgtctgccgctcaatccggctcagaagctttctgatgatctgttgttcttgcacgttcattcacttccgtcatgattagtttaataaggaggatgagaaagtgattcggtatcctaacggaaaaacatttcagccgaaacattcggtttcatcccaaaacagtcagaaaagggccccgtcttacagtaatcgcggaatgaccctcgaagatgacttaaacgaaacgaataagtattatctgacaaaccaaattgccgttatacacaaaaagccgacacctgttcaaattgtaaatgtccattatccaaaaagaagtgccgcagtgattaaagaagcttactttaaacaatcatcgacaacagactacaatgggatttacaaagggcggtatattgattttgaggcgaaagaaacgaaaaacaagacctctttccccctgcagaattttcatgaccatcaaatcgagcatatgaagcaggtaaaggctcaagacggtatttgttttgttattatatccgctttcgaccaggtttattttttggaagccgataagctgttttatttctgggacagaaaagaaaaaaacggcagaaaatcaattcgaaaagatgagttggaagaaacagcttatccgatttctcttggatacgcacccagaattgattatattagtattattgaacagctttatttttcgccatcatctggtgcgaaaggttgattaacgaaaggttgagatgttatgtcagatcaatttaacagccgtgaagctcgacgaaaagcgaacagcaaatcgagtccttcaccgaaaaaaggcaagaaacgaaaaaagggcggattgtttaaaaagacccttttcactttactcattctgtttgttttaggcgtagttggcggtgctgttatatttgccgtcatggtttctgatgcgccgtcccttgatgaaagcaaattgaagacgccttattcatcaacgatttatgataaaaatggaaaagagatcgccgaagtcggcgccgaaaaacggacctacgtctcgatagatgaaattcccgatgttgtaaaagaagcctttatcgcgacagaagacgctcgtttttatgagcaccacgggattgaccctgtccgtatcggcggtgcattagttgccaactttaaagacggcttcggggctgaaggcggaagtacgatcacccagcaggtcgtcaaaaactcccttctttcacatcagaagacgttgaaacggaaggtgcaggaagtatggctttcgattcagctggagcgcaattactctaaagatgaaattttagaaatgtatttaaaccggatttatttttctcctagagcatacggaatcggaaaagcggcggaagaatttttcggcgttacagatttaagcaaattgactgtcgaacaggctgcgacgcttgcaggaatgccgcaaagcccaacagcgtacaacccggtcaaaaacccggataaagcggaaaaacgacgcaacatcgtactcagtctgatgaaaaaacaaggatttatttctgattctcaatataacaaagcgaaaaaagtggcagtgaaagacgaaggcgtcgtgtcacagaaggaatatgaaaaagcaagtacaaacaaatacagcgcatttgttgaagaggttatgaaggaaattgatgaaaaatctgatgtcgatccatctgctgacggattaaagatctatacgacattagatacaaaagcacaagataaactagatgaattaatggacggagacaccgtcggatttactgaaggcatgcagggcggcgttacccttctcgatacgaaaaccggagaagtgcgggcgattggcgccggaagagattctacggttggtggctataattacgcgacccaagctaagcgacagcctggatctaccattaaacctattctcgactacggtccagttattgaaaataaaaaatggtcaacttacgagcaaattgatgactcagcttacacgtattcagatggaacacctattcgagactttgaccgttcctataaaggggtcatgtctatgcgtgaagccctcgcccaatcacgtaacattccggctctaaaagcattccaagcagtcggaaaagatgcagcagttgattttgctaatggactggggctcggattaaataaagaaaaagtgtatgaatcatattctatcggaggattcggagaaggtaatcccggtgtctctactctaactatggctggagcatacagtgcattcggaaataacggaacatataacgaaccgcattttgtgaaatcaatagaatttaatgacggcacgaagcttgacttaacacccaaatcaaaatcagcaatgagcgattatacagccttcatgattacagatatgctgaaaacagctgttaaaacaggtactggacagcttgcacaagttccgggagtggaagttgcaggtaaaacaggtacaacaaactttgatgaagcggatatgcaaaaatacaatatcgcacaaggcggtgtaccagattcttggtttgtaggatatacacctcaatataccgctgctgtttggacaggtgtagattctcaaaataagataggaaaaaaatctttaaataaaacagagcaacagattgcaaagcgcatcttcgcccagctcatcgccgatgtcgatgacggaagcggatcatttgagaaacctgacagcgtagtggaagcctctgtagaaaaaggctcaaaccctgcaaaactggcagggccaaatacgccaagcgataagaagctcacagagtactttgttaaaggcacagctccttctactgtttctaaaacatatgagaaagaagaaaaagaggaaacagctaaactgtctggtttaaacgtgaaatacgataaagacaatcaatctttaacgttaagctggaattacgacggagatgcgacctttgctgttaagcaatctgttgatggcggcagctactcagaaattcaaaacagctctgcaaaagaggcagtcatatcgggtgtgcagccaggatctgtgtacaaattcgaagtaacagccgtcagtgatgatggcaaaagtacagcttccacatcctatgaggtgccaaaagctgaagacgatgaagataaaaaagaccagcaacaaacggatgatgaaaaacaagatgatgagaagactcaggatgatacacaaactgatgattctcaaaaagatgacggtcagacggatcaagatcagacagatgattcaacaaacgatcaagacaaaaaacaagacaatacgaacaccaatccgtccgacaacaataaccaagaccaatcaaacgataacgataacgacaacagtaacaaccaggatacgtcggatggtgattcgaactctggtaagaatgattcaacaggttctgacacgaataaaaataaaacagacacatctaataaaacacaaacaaactcatcatccattgaaaaaacaaattaaacaaaaaagccgtcacctttggggtgatggcttttttggtacacaataaaaaacctcccgttttaacaggaggttttatcgattcatcgcatgatatttgtaaaaatgctttttcatttcggtaaacagctcatcaagctgaataaagcaatggtattgggtcggcttaagaagaataaattccactcgttcagcccaattaatcggctttgcgggatatgatttctccctcaattcttgccaatcgagcgatttcaccggctcacctgctgtccaatgtaacgaagccagcaaacacacaatgccctttaacatttcgttttggtcacatctcgattttcgtgtttgaaagactgggagaagtgatgctttgatgtcatcccacacttcaaataaaagcggaacgtatttcccgctgtcttcccatggcaaatcgccttgtaattccgtgcagaaatcaaaatacacgggattggtctgcaaggttttcttcatatccgaggaactcttctggccaagactgcgcaagtattgctcataagaagccaacacttcttttgcttgcgtcatcgtttcaccagtccttttttatccctcttctgcccttctctgcacaaagaaagcagcggacactccgcacagcgcggagattgggctttacagtgatatctgccgaagaaaataagccggtgatgcgtaacggaccagtcttctttgggaaccttgcgcatcagcgtcttttcaacttccagaaccgagtccttccaccggcaaatgcccaatcgtttgctgactctctccacatgggtatctacggcaatggccggcacaccaaacgcaacggataccactacgtttgcggtctttctcccgacccctggcagtttgacaagctcatcgcggtctctcggcacttctccgccgtaatcttcaataatcattttactcagcttttgaatatttttcgctttattacgatataaaccgattgatttaatatcctgctgaagctcttccagcggaacagccaaatagtcttccggccgtttatatttttggaataatgttttggtcactctgtttacaagtgcatctgtacattgcgcagataaagctacagccaccactaattcaaaaggattggaatgaaccagttcacactccgcatgaggaaacatgtcacctatcttgtctaaacagaattcaatttgttttagatttaacacgattgtcaccttttcactttattgttcaagccaattgtaaaaaggaacctgccttttatactctttttgcggttcattctgctttgcttgtacacgccggaatttttggctgtgtatttttgcctgctccacagttttaagcccgtttttcttccattcaaacaaaatccggtcaatgtagcggaaactgagttttcctgatagtacagcctcttttaacgcgtgtttgatcagttgtgcgtcatgctggtcctggtcctgccagatcgccagcgtttcacactccaaaggcgataacggccttgcgaactcttcctcaaaaatggtataaaggcttttttgttccccttctgcttttctttcctgtgtttgattctgtgcaagctgaatatactcgtacagcttgccccataaaggctgaagagaatatttctcaaatttgatgccgttttgatcctcgcattcttcaataaacagaaagcctttttgaataaacatccgcaatctgtttgtgcattcttcaacagaaattgacataccttcctgcagctgattcggtgtaggaaaatatgatcctttttctaaatgcattttaatttttaacagcagaataagttctgtttcattaagcccaagctgtttataatgcgtgagcagaagattggggatggttgatgttccctgctcctgcatatcaataaattgctgttttttcatcgtcacacctcttactgtaaaggattgtgattacccctttactgtaaaaagtctcccttgcaggagactcttttttgtttcatttgaatgtattacggatacagacggtttaacagtcttgggaacggaatcgtttcacgaacgtgaggcgctccgctgatccaagctactgtccgctctaatccaaggccgaagccggaatgaggaactgatccatattttctaagttcagcataccatttatatgcgtcagaatccagtccatgttctttaagacgcgattccaaaagttccatatcgtgaatccgttcagacccgccgatgatttctccatagccttccggcgcaatcaagtcagcgcaaagcacaacgtcctcacggtcagaagccggctgcatatagaacggttttaaggacgtcggatagcgagtgatgaataccggtttgtcataatgttcagcaatcgctgtttcatgaggcgctccgaaatcatctccccactcgatatcgtcaaagcctttttctttcagaaattcaatcgcttcatcatacgtaattcttgggaacggggctttgatttgctcaagttttgacgtgtctcttcccaatgtgtttaattcaattttacaattcttaagaactgattgcacgatgaaagaaacgtaattttcctgtacttgaaggttttcttcaaattctacaaacgccatttccggttcgatcatccagaattcgattaagtgacgctttgttttagacttttccgctctgaatgtcggtccgaaagagaatacttttcctaaagccattgccgcagcttccatgtagagctggccgctttgagacagatacgcatcttcatcaaagtactttgtcgcaaagagttctgttgtaccttcaggtgcgcttccagtcaaaatcggcggatccacttttacgaagccttcgttattaaagaattcgtaagtcgcgcgaatgatttcattacggattttcatgatcgcatgctggcgctttgaacgcagccataaatgtctgtgatccatcaaaaattccgttccgtgttcttttggtgtaattggataatcggtcgcttcgtgaatgacttcaatatctgtcacagcaagttcatatccaagcggagaacgctcgtcctctttgacaatcccttttatatagagcgacgtttcctgcgtcactgatttagctgtttggaaaatgctttcttccacttccgcttttactacgacaccctgaataaaaccggtaccgtcccgaagctgtaaaaacgcaattttcccgcttgaacgcttattagcgacccaagctccgatcgttacttcctcacctacgtgcttgtacacttggttgattgttgttttcaacatatttccctccaaaacaagaaagacattcggaagctcattgccccgcgaactcttttatcatcactttattatacccgctcttaactaaccgggtcaatgcagataaaaagcggcttttctgtcagccgctttttgatctgttagctatgtttttctacaaaacgcttgattctttcaatggctttttcaagaagatctaacgatgttgcataagaaagacggacattctcaggagagccaaatccggatcctggaacaatcgcaactttttcctcctcgagaagcgctttaacaaattcatctacatctttgaaaccgcaagattgagctgcctcttttgcatttgggaacaagtaaaaagcaccttccggcttcacacagctgaaccctgggatttctatgagctttgcatagatcgtatttaatctatgttcaaatgcttctctcatttcttccaatggctcagaaggcccgttataagcagcaatcgctccgtattgtgcgattgatgtcgggtttgacgtgctgtggcttgcaaggttcgtcatcgctttaataatgtcttcagagcctgccgcataaccgattctccagcctgtcatgctgtgggacttcgatacgccgtttataatgaccgtttgctctttcagtctgtctgacagctgtgcaatggaaacatgtttctttccgccgtatgtaagtttttcataaatttcatctgacacaatcaagatatcatgttcaaggcacacttcaccgagcgcagacagttcttcttccgtatacatgacaccagtcgggttgcttggagagttaataacgattgcttttgttttttccgtaattgcatttttcagctgctcaggcgaaattttgaagtgattttcctcaagcccttctacataaacaggctttccgccagcgagtttcacctgctccggatagcttacccagtaaggcgttggaataataacttcatcttcttcatccaaaatcacttggaaaagggtatacagagcatgtttggcaccagtgcagacaataatttgagacggtttgtattcaatattctggtcgcgtttaaatttctctgcaatgctgtttttcagttcagccaaaccaccggaaggcgtgtatttcgtatggccctcgttcatcgaacgcacagcggcatcaataatatgctgcggtgtattgaagtcaggttcgcctgctcctaagccgatgacatcatggcctgcggctttcagttctttcgctttcgctgtgattgccagtgtggttgatggtgttaatgcggatactcttcttgccagtttcaacttgaactccccctaattcgtcttaaggcgtgatatttttgagaatctttccagttgtaaagtccacataacttaaactgtattgcccttctttgtctaagtacgtcacttcccaaagcaggacgtttccttctcttgccagatgaacctctttttgctttgaaaccagcccttcatcctttatgattttcgccgctttgtcttcagagattccctctttcgcttcttttgagagaatttttgcttttttatcagcaggaacccagacatataatgcagtgccttttttatccgttccctttacaacataatatttttcttttccgacaaatgtttcgacttgatcaacattggcgagatcggtttcttttttagcttcagcagctgctgcttcgtgcccctcttccttttgtgccatggctgatttataaatgcttgccgagacaagaagtactgctaaaaaaataataccaaaaatgacggtaaatattaatgctttttttctcatcttctcacctacgtacgataaatggtaaaaacggcttggtttttgttttcttcatccagtgcaaggccgaacatcagattttctcttttcagtgtacgattcaatgtgtccacaattttatacagatcatcagaatgctctacattaattgttgaaagaatttcgattttactttccattttttcatcctccagtttgaacaaatattgtaagtcatactccatttcaggacacgccatactagtatcacagagcgggaaatccgcttttaaataaaacaccatcctactcccacaccgcaaaagccgctttatgcggcttttattctttttcccctgcaacataagcttcaagctcgctgtcagtcatttcggatactgaggttgtcggcaaggcatcaagaaacagccggccgtaaccagcggttttaatccgtctgtccaatataataatcgttcccttgtctcccgcagaacgcagcaagcgtccgattccttgcctgaaggtcagcacagcttccggtaatgacactgtttgaaacggattctttccttttttgcgggcaagctcacattttgcagcatgaagcgggtgatcaggggaccggaatgggagcctcacgatcattactgtcgtcagctcatcaccagggaaatcaacgccttcccaaaaatgatttgttccgagcaggatcgcctgattggatgttttaaaagtcttcatcagcttgccgggacttccgcctgtaatcccttgtgccaagagctgaatgccggaagcactcatgttatgcttaagctcctggtgaacctttttcagcatatcatgggatgtaaacagcacaagaattttaggctgtttttcctttgccatcagttcgatataacgggctgtatcctgtataaattcaggttgccctgtatcctgaattgatttcatttcctttggaatcatcacctgcatacgctcatcgtaagaaaagggtgactcaattctcattgtccgcgggaaaaagtcactcagtcccagtcgttcaatcataaattgaaaagaaccttcgactgtaagggttgcagatgtcagcaccacactatttttgcgcgcgaaaaactgatcagccagaagttcaccaggttcaagaggctgtgcgtaaatggccactgcatttttcgcaccctttgcatctatttcaatccaaaccgcttcatcatcatcagacccaaagaagagcttctgcaacgtctgacagtaatgctgcaagcctttcatgcttctttggtattcatcggctaaaaagacggttttgctcttcatacccttcaaatgtttttccatcagggatgactgcgcctcaaaaagctgctgcaaatttgtcagcatggaacaaagcctctccgcaccatccgttaagatcgaccagcttttatcctggctttctttgttcaccttaaacactagacggtttaagtcttctttaggttttcttcgtttgacaaaagaatgtacagagctgaagaaagcatcactttctgcttgaacgtgctgaagccactcttccaattcgaaaaatgaatcaaccggcaggctgtttcgctggaatagctgtctcatcttttttagaagtccctgctccttcagagtgccgattctgctcaatttcgtatgcaattctatgtacgtggctcttttccctaaatgttcgcttgccgcacgttcaaaatggtgtgcttcatcaataataaatgtcccgctttcgggaagcctttttttctggctgccttcatcggtcagcaaaagggaatgattggtgattaccaaatcggagcgcatagcaatctgtttggcccgctcgtaaaaaccgatcacatgctcactgcgacttcttttataggagtcatcgtcataagccaatctgtcccacagcaattttccgcctgaaggcaaattcagttccgctacatctcctgtatttgtctctgtcagccaaacaagaagctgtgcctttgtcagtacggcatcataattatcatcttcttcatgaagcacctgctcaaatttatacaggcataaataatgcgattgcccttttaaaatcgccgctgttaccggaaatggaaacagatcttggacaatcggcaaatcctttgtgagaatctgctgctgtaaaagcgtcgaatacgtgctgattatgaccggcttttttgatttcttggcaaaaagcgcagccggaataagatagccaatcgtttttccgatgcctggaggagcttcaatcagcgcatgctcacgattggcaaacgcatcagccacctctctcatcatcatcatttggccgtctcttttttcatacccaggcattaactctgacagcgctttttcatttcccgcttcccagctttcgatctcaaatgagaagttctcgtcctcatttatacgaacatcgatagcttcaggttctctgacagaaaacgaagaaaagcgcgtatagcccggtatctcggtatgtctgttttcattaatgaacatatccaacaaatgcgtcagatcactgatgaaatgctgcgaaagccttcttaactgctttaatgtcggataaggaagctgccgcagcttttcaaggatttccaaaaaaataagccctgtcacttcagcatcgctgtcagcccggtgcggctgatcatgccgcagctgaagctcctcgcttaattccgtcagcttatacccttcaaatcccggaaaaacaatgcgtgagagctcgacagtatcaagcacttcacaatctgggagctgaaagcccgccttatgtagctcatacttgacaaatccaaggtcaaaatggatattgtgggcgacaaaataagcgccgtcaagcaattggaatacttcttcagcaactgcttcaaatggctgttcattttctaccatttgattagagattccagtaagctgctcaataaaagcagggattgatttatttggattaatgtattttgaaaaccgctcagtaatttgtccattttcgattacaaccgctgcgatttgtatgattttatcgcctttcttcggcgaattccctgttgtctctacatctataacaacgaaccgttgcttattcattaaaatggacacctcaattcttgcatacgacaaaagtgtaacacgttttgtacggaaatggagcggcaaaaccgttttactctcaaaatcttaaaagaaaacccccgataaagggggcttttcttctacaaaattgtacgggcgggttcgtttcccagcatttgttcaattttgttttgatcattcagaacagccactttcggctcgtggcttgccgcttcttgatcagacatcattttgtaagaaataataatgaccttatctccttcctgcacaaggcgtgcggctgcaccgtttaagcatatgacaccgcttccccgtttaccaggaataatatacgtttcaagacgtgctccattattattattcacaatttgtactttttcattaggaagcattcccacagcatcaatgagatcttcatcaattgtaatgcttcccacatagttcaggtttgcttccgtaacagttgccctgtgaagtttgccgctcatcattgttcgatacatattatattctctccatttctcgaatatcaataatgatgttatctattaaacgcgcttttgaaaaagcaactgcaacagcgagaatcatctttccagcaatttcattcacaggctcgagttccggataggaataaagctctacatagtctatggttccgctagtcgtttcaatgatttcttttgcagcttttatcaccgcttcaggatctctttcaccggcttggatcagttccgcacttgtttgaagggcccgatacagcttaggcgcttcttttctttcctcagctgttaagtatacattgcgagagcttttggctaagccgtcttcctctctgaccgtatcgacaggaaccaattcaatatccatgaagaagtcactgattaacccatcaacaacagctacctgctgcgcatcttttaaaccgaaataggcacgagtcggcttgactagattgaaaagcttcgtcagtacgatcgcgaccccgtcaaaatgtccttctcttgagcgcccgcataacacgtctgtgcgtctttctacatgaatcgtgacattcttttcaccgggatacatatccttagtatctggcgtaaaaagaatatcaactccggcgttttctgcaagagctgcatcccgctcaatatcgcgcggatatgcttcaaaatcttcattagggccgaattgtgcaggattcacaaaaatactcataataacggcgtcgttttcttgtcttgctttgtctgctaaggttaaatgcccctcatgcagaaaccccatcgtcggaacaaatccgattgacttgccctctgaatggtattgttttatggcttctttcagctgtgtaatatcagtaatctgtctcatcttattttcccccgtacaagccgtcaagcactgtctggttcatttgaaaggaatgcttttgttcagggaaagcacgatgtcttacatcctgaacatatccgctgattgctgtttcgatggtttcatcaatgcgcgtatattgctttacaaatttaggtgttctctcaacaccgtggccgataatatcatgataaacgagaacttgtccgtctgctttcacaccagccccgattccaatgaccggtatgcttagcgtctcggcaattttggctgtgagttctgccggcacacattccagcacaagcatcatagctcctgcttcttcgcattttatactgtcttctattaattttttggcgctttgttcgtctttgccctgtactttatagccgcccagtacgccgactgactgcggtgtcaaacctaagtgactgactactggaatgcctccaagcgttaatgcgcgaatggattcaaacacgccttctccgccctcaagcttcagtgcgtcagctccgctttcctgaacgatagccgctgcatttttcagcgtatcttccttggacaggtgataagacataaacggcatatctgtcacaataaaggtattcggcgcaccccttttaacggcttttgtatgatggatcatgtccgcaactgtcacaccgacagttgaatcaaggccgaggacgaccattccgagtgaatcaccgactaaaatcatgtcaactcccgcttgttcagcaagtttagctgccggataatcataagcggtcagcatgacaatcggttcttcagactccttcatttttagaaaatccagttttgttttcatgttttctcctcctcatgtttagaggagatgatctgccgttttcttctgcaagccaaaaaaccttccgttacaacgagaaggattcttcactttctaaagttcggcgagtttcatccctctgtcccagtccttttttggatcaaggcagactgctgcaatgtctatctattttaacaataggtgcagttcgcaggcgatactgcccaatggaagtataccaaaatcaacgggcttgtaccaacacattagcccaattcgatatcggcagagtagatttttttaatgccttcgttcgtttctaaaagcagaacgccttcatcatctatacctaacgccttaccgtaaaaggttccgtttaacgttctggctctcatattagtgctaataccgagcgcatagctttcccataaaagcttaatcggcgtaaatccgtgcgtcatataatcccggtaccgtttctcaaagcatagtaaaatatgctggatgacgccggcccgatcaattttttccccagcagcttggcagaggcttgtcgcgatgtccttcaattcatctggaaaatcattaggctgctggttaacgttaatgccgatcccaatgatcactgaacgtacgcgatcttcttcagcctgcatttccgttaggatgccaactgttttttttccgttaatcaaaatatcatttggccatttaatatccgtttggatgcctgctgcctcttctattccctgcacaacagctactgcagcaagaagagtcagctgcggtgttttttggagcggaatgtcaggccgcaaaatcaggctcatccaaacgccgtttccttcttgagaatgccataccctagacatccggccccttccggctgtttgtttgtcagccaccacgagggtgccttccggtgcgttattattcgcgagctcatgagccgttttttgcgtgcttgaaagaacgtcatggtaaataagatgctggcccatcacttccgtttttaatccaaaacgaatttcgctttcactgagttttccgggttttttgatgagccgatatccttttcttctaacggcttctacttcataaccctctttccgaagctcttcaatatgcttccacacagcagttcttgaacagccgagagcatcactgattttttggccggaaataaattcattgccggcctgagaaaataattcaataaggtcttttcttaatgttgaccgcatgtcttcagccactcctctatgtgtttcttttgattggagagcttccctgtcacaacagcctgctcgatccgctgtaattcttccgacacccattttccagccggccggtttcgaagcgcaagcaagtccttacccgtgatatcaagatccttaaggcttttgatcggcaggttttgataagcgtactgaatgtccttcagtttcttttcatccagtttttcgttttgccgaagctgcgatactttggccgctgagagcagtgctttttccccagctctgtacattgtcattgcgtcaaggctctggccaaacgtatcggcaatgtgaatggcttccttaatcacttttcccgggagcttccaacctttcaggaaaaggggcgcgtctttcaagactatgccaaggttaattaaaagagcagcccaaagctcctcacgggatgttaaagagaagaatggaaactcactcgttgaaatcaggttttctcgtttatgataaaaaccaggaagctcttcatacaatctcgtttgaatgagtgtttgaagcgcctggcgagaagctcttccctgcagcaatttctcgaactctatagtttttcgttcgactgaaacatgggagaggagtgatttttctttcgcaatggcttcttctgtttccggtgaaagcgtaaagccaagctggctcataaagcgtacggctctcagcatacgaagcgcatcctcttgaaatctatcctcaggctttccaacggttcgaatcactttctgatcaatatctttcttgccgccaaaataatcaagcaccttcccgtccgctgtcatggccatcgcattgatcgttaaatctctgcgttttagatcctcttctaatgatgagataaattgcacttctgacggtcttctgaaatcaacataatcagattcagtccggaatgtcgtgacttcataggtttcatcctcccagagcacaataatggtcccgtgctctttgcctacatcaacagtccgctgaaacagccgttctacttgatcaggtgccgcatctgtcgcgatatcgacatctccgatcgttcgtttcatatagctgtcacgaactgcgcctccgacaaaataagcctgatggcctgcttcgattaagatgcggagcacgggaagtgctttgataaaaactttttccatgtgatcactccggttctgctaaatcggcataaatctgttcatactggctgacaatttttttagaagaaaattcattttcaagcatctctattgccgcctttgtaaaacgattgcttagctgttcatcttctaaaatgctcatcgcgcgggctgttgcggccgtaacatcaccgacatccaccaaaaatccgctcacattgttttttataacctcagggataccgccaatgtttgttccaatacaaggcactccgcaagccatcgcttcaagcaggacaaggccaaagctttctttttcagatagcagcagcttcaaatcgctaatagaataaagctcttcaacacggtcttgatttccaagcattaagacttggtcttccaagccatattttctgataagctcgcaggctgtcgatttctccggaccgtctccgactaaaagcagcttcgctttcgttttgccagcgatattgcggaacacacggatgacatcctgcacgcgtttaacttttctgaagttggacacatggatgacgactttttcatctggtaaaattccatgtttctctttaattgccgctgtgtttttcttcagatacacgcgctcgtctataaagttataaatcgtttcaatttttttctccggtttaattaaatcgtacgtttcagccgcaagcgctgaggagacggccgtcaccctgtctgatgactcaatagcaaaacggatcagatcttttagagacggatcataacctaacaccgtgatatccgtgccatgcaaagtggtaacaatgccgatattgcgtttcagcatttgttttgcaagataggcgcaaacggcatgcgggagagcatagtgagcatggataatgtctaaattctcccgttccgccacctcagcgattttgcttgccaatgtcaaatcatacggaggatacttaaaaacagcatattgattaacctcaacttcatgaaaatgaatattgggatgatatgtattcagtctaaacggaatgcttgatgtgatgaaatggatttcatgtcccttttcagcaagctgcttccccagttctgtcgcaatgatacctgagcctccaacgctcggatagcatgtgattcctatttttagttttctcattgttcgcccccaagcacatcatgatcaagcatcagcatccgtttggaaaagaaaccttcggcatactccacgcccgcttctttaccgtaaagcttttctctcgcttcaacgatttcaatatacccattcgtcagaggagtagaaacggaatcctttgacgggataaactggcttttgtaggcgttgaggctttgtttctttgcctctattgtatccgagatatcaataacaaaatccggctgatgaaaaccatttatcatataatagtaaaccttgctgactttatgcgccggaaggcttttttcgtctttatatttatggattccggcggaaaagatcgcttcttccaccagtgcagccgcattggcgtgatccggatggcgatcctttttatacggcataaaaaccgcttttggccgacagattctgatgacagtgacaattgaccgaattgcctgatcactcattattaggccgcggtctggaagcgttagctgaattcttttatctgcgcctaatatgcgggctgcttcagctgcttcttctttacgcaaactgaccgtaccgttagaagagagttccgcttctgtcaaatcgcatatcattacttttttttcctgtttgacaaacttcgctattgtgccgcccattccgatctcgacatcatcactgtgggcgccaaaagcaagaacgtcagcattatacattcggctcttctccccgaagaaggtcacggaattcgaaaacaccttcatcaagtgtgcgcacaagaatttccgcagtacccatatttgtggcgagcggaatggaatacacatcacataaacggattaatgccgagacatccggttcatgcggctgcgcggtcagcgggtcgcgcaaaaaaatgacaagatcgagtgcattggcagcgatcagtgcaccgatttgctggtctccccctaaagggccggattgaaaacgttcaatttgaagacctgtcgcctcatgaattttcaaccctgtggttccggttgcgtatagatcatgattctttaaaatatcccgataggcagtcgtaaattgaaccatatcctgttttttcttgtcatgcgcgatcaaagcaattttcattgtttatccccccgtctaatcaatgatattttctaaaccatacacaagctgatcaatcttcatgacttgttcgactgacagtttaacgcctgacatgaaagaagcacggttataagaatcatggcgtatctgaagcgtttggccatccatgccgaacatgacctcctgatgcgcgatcagtcccggaagacggacgctgtgcaagcgaataccgttttgctccgctcctcttgctcctgggagaatttctttttcatccggatgtccttgctgcttttctttacggacttctgaaatcatttccgctgttttaagcgcagttccgcttggtgcgtcaagcttctggtcatgatgaagctcaataatctcaacatcctcaaaatagttggcagccatttttgaaaatttcatcatcagtatcgcaccgagcgcaaaatttggcgcgatgatggctccgatccctttttcttctgttaaagatgtgagctcttttaaatcagcttctgagaaaccggttgttccgacaactggacggactccgtgctctaatgcaatttttgtatgtacttttccgatttcgggcgttgttaaatcaatcaagacatccggttgtgtttctgtaaaacaggcatggatatctgtataaatgaaagcatctgactcaacaggcatcacatcagataatttttgctgatcgtatgtatggtctatggccccgacaaggtcaaaatgaggtgttcgttctgccaatttaacagcttcctgccccattcttccacgcggtcccgcaatgactactttaattgtttcgtttgacatctcgatctcctctactttccttcttcttttctggtccagcgatctttatctcttgtattaaatttatgcatgactcggtcgtgggcttcctctaaagagatatcaagggagttggctaaacaaaccaatacaaatagcacatcgcccatttcctcttccatgcttttatcatcttcagtcgctttttttggtttttctccataacggtgattcacttctctggcaagctcgcccagttcttcagtcagcctcgccatcatggccagcgggctgaaatatccttctttaaattggccgatgtaacagtctacttcagcctgtatgtctttcattgttttatcactcactgaacgaaacctcctatcatcctcttacatgttagctaattcagatacgtttgacaaatgtttaagcacgtttgctgttttctttttcatccactataatataaacgctatctaatggaaggaaaaggggttttatgtgatgcttggagaaattagattaaaaaacatattttttattttaatcggagcggcaattttttcatttggcttggttcatttcaatatgcagaacaatctggctgagggcggttttacaggtattacacttttgctttatgcccttttccacatcagcccctctatatcgaacctggtgttgaacattccgattttttttattggctggcgtttgctcggcaggacaatgtttgtttatacccttgtcggcactgtagccttgtctttgttcctcagcatctttcagcgatatgaaatccatatgccccttcagcacgacttagcgctcgccgctttatttgccggcgtattcatcggagccggcctgggaattatttttaagttcggcggtacgacaggcggtgttgatatcatcgcacgtttagtgaataagtattttgggatcccgatgggcagaacgatgtttgctttcgatgcctgcgtcatcattttgtctttgcttacttatctctcctataaagaagcgatgtatacgctggtagctgtatttgtagcggcaagattaatcgattttattcaggaaggcggatacgctgctaaaggcgctacgatcatctcttcgaaaaacgacctgattcagaaaaagattcttgaagaaatggaacggggcgtcaccattttgaaaggacaaggctcctacacaaaagaggatatagatgtactttattgtgtggtgccgaaaaacgaattggtgatgctgaaaagcgtgattaactccattgatccccatgcctttgtagcggtaagcgatgttcacgatgtgctcggagaaggatttacgcttgatgaaaataaaaatccgcttccgcgctgacatgtaatagaaaaaaggcggctgaccgccgcccctcacccttatttagggtagtccctttttttcagcttgtttttttccgccttgtactttctgtaaccgacataggtaagagcagtaatgatgatactgccggttgtaatcatcacccagagtaaagacggatcggcatcatcctcctccaccctgtcaaacacatttttcaggtcatgctgaagaagggaaagccgttcaagcttcgtgctctctgtcatttgctgaaattcctcttgctcaataacatctatatgttttccgactgtttcaagctgatcctctgatacatcgattgtaagactggggtaaatcaagtcatataaactgataaattcattccatttttcatgaaagcttatgcttccattcttctggacatctcgcttcagctcagtaaaagcttccataatcggtttttccagtgagccccaaagcgggtcagaccgattgtcaaccgcatccatcagcattctgaactgcgcggctgctctgagtttttgtgtgtctgatgtatcagcttgctttaaactccgaaccatatcattatagcccaatgtgatttgacgaatttgggctcccgttagcatggggtcttgctgttttttctcagcggattttaatgttttttcaaaatactccaagacttgaagcgcctcttcatatttcgcctgtcgggtcatttgaaagactgtatcggataaatcattcaattcctcgaggcttccccgctctgcagccttggcatttccattataaaaaataagtgcaatcaacaaacagatcgtcagctttcgtttcatgcaggtccctcccactctctctccttacagaatatgaagaaagggacaaggatagaccaacattgtctttacatcagctcaagcttcgtttgtttttttgagaccacaagaaagtaagcaagcgcgattgaaaagatgcttagccaaaatgttccgtatcctatttcagtcatataatcagaaagcatagagtattgcggcatcatatcaaacaagtagtcaatgacatcgttatgcagtgtccagactgcagcaattgcaagatgccaaaatgaaaaacgaaaatacggactgtataatacgccttgaactgccattgcaaaatgcgaagcaattagcatgtagccctcccacggcaagtcaccagttactgcaagcacaagaaaattcatagccaccgcccataggccatactttacgagggtaactagcgcaagcgcctcaaagaacggagcattccgtttcatgagaaaggcaagcagcacaaacagaaagaaaaacgttgctgtcggactgtccggaacaaaaatcaggaaacgtgccggtgtctccaaaagctgcggcaagtaccaatagtagccgtaaaccgttcccagaaaattaatggctaagacaagaataagcatcggccgctgccctaatacatattgaaaccatttcacatcgaatcaactctcagtctgtaaaaataatatgtccaaataaaaaagctgacgccgggtcagcttttgataataaaagtatatccttccatttgacaattcacaatacgttattttgcggttgtttcagaaataaattttgcaagttcttcgagctgcttatcatttcctttgaacacacccgccggcattttgcctttcccttctacagcgatttttttgatttcatccggtttcagcccgctgtcaaccaatgaaggcccggccgctcctccctgaaggttatccccatggcaagaaatacagccctgttccttaaaaaccttatatccttctgcattggtgtcaatgtcggcttcttttgtaattttcccctgttcttctgccttggcccagtcatgagtagcaactgactgccacgtcaaaaatacagcagcggaaatggccagaagcatcataccgacagcgaccggacgcttccacggccttctttctgtccctctgtctaggaatggagccaaaagcagggccccaaaagcgagacctggcataatcatggcgccgaccactgtaaagcttccggcggcgtattcatacttcaacagctggtataagaaaagaaaataccaatccggcagcggaatatacccagtatcagtcgggtccgccatccgctccaaaggcggctgatgcacaatcgtcaaaacgagaaaaccgatgagaaagacagctccaaccatccattcctttaacaagaaatttggccagaaagcctctgttttacccggatactccgaataatccttcggtatattcggctttttttcagccggtatccttgagtcgcctacaaatttcatccctttgccccggtgcatgtcatcccctcccttttattcgcagatcaagagtttaaagcggtcctgaaatcccctgcttccggatcataataaaatgtgcagccatcagcccgaacaatgcggcaggaagaaaaaatacatggatcgcaaaaaacctagtcagcgtttgggcgcctacaatatccggatgccctgcaaggagcgttttaacttgcgttccgatcaaaggcgtagcttcggcgatctgcagcccgacttttgttgcaaacagagccttcatatcccaaggaagcaagtagcctgtaaagccaagaccgagcataacaaaaaagatcagcacaccgacaatccagttcagctcgcgcggttttttatacgcgccttggaaaaagaccctcagcgtatgtaaaaacatcatcacaatgaccaggctcgcaccccagtggtgcatccccctgacaatctggccgaatgccacttcattttgcaaataatataccgattcccaggcatttttgatatcaggcacataatacatcgttaaaaacattccagataatacttggataacggttacaaaaaacgtcagtcccccaaagcaatacacaaacgcagagaaatgatgggcgggattcacatgttccggtacttcgtgatcggcaatatccctccacatcggtgtaatatcaagccgctcgtctacccagtcataaattttgttcagcatgtcacccttcccccttaggctttgcttttccaagatacaggaagccgtcttttacttcttgctcataatgatcaagaggcgcaagcggcggcgtgccagggacattggtgccgtccttttcatagagtccgtaatggcatggacaaaagaatttattcgggtttttaggatcactattccagttcaccgtacaccctaaatgtttacaaattggcgaaagtgctacaatttcatccccgtttttgaagacccaggctgatcttgactcttctgactcataccaggcatcgacttgattaattttaaaatcaaagcgctgcggctcttttgtcaactcatcaacgctgacaacctgaaccatatcctgcttccctgtcgattttaataccgggtcgagtgcgaagcgaaccataggcatgagcatactagccgccataaaacctcctacacctgtgagcgtgtaattcaaaaattgacgtctggatatatcatgttttccgcccatctcttctcccccctctaggtcacccctgcaaactgactaaaatagaaaatattgcaataactctagacaccctcataatatatgaatctctcagcaaggtcaatatagccaaaatattgtttataaggaaatgtaagtgtttttatgaagtgctccataactgtaacaaaacgttcaaaatttcagcagtgcgttcatccaatatttttcttattaaagagtcatttaaatgctctaatggaacagacggtgtaacaatgattttgcctaacgcatcctcagctctccaactttcgtcagatgtgagcaggacaacatgcggaaattccgttatcagctcttcccgcaaatccttaagcccttgaacggttatttcatttctatcaacatatgtataaggcggaagtaaatatacccgtccctttaactgcctttcaagttcttctgagagaagctgcgtaaactcgcctttctccgccgccattttaaaatggttattaacccttatgttaattaatggtatgacagcggtatcaatgtaatccttagcttgtaaatagtccttggcatcagtgattctccacctcatcgttctccccctttacggcaacaagccttgcaattcactgcaaggctggtcatattatgtgagctgatttaattggcgcgataattgttcaaatgcctctttatcatgacgatctaacgcctcgtcaatgtcttttaataatttttctctttggaatgtggaaatagcgtgctctaaaatctgttccgccaatccctgatcttttttattctcaaaaaggtttttcggaatatgcgggttggactccagcaccgccgcatattcaggtgagctgtaagccgaacggaaattaagctggataaacaaatcctgctgtttatttaatctaatatcatgaaaagatttttccgcgtcggtagtcatgacattctctttatagaaccggaacggaacttcttcaacacaatgtgttgacattataatgcctctcgggcaaaattcagcctgctccacaaaatgaaccttctccatgagagaatcatggctcattaagtagttcaagatccaaacgcactctcggcgctttaactgataatggtttaaaaaccaacggataaaatcttttttctcattgacagaaacaggggtctgcatgtaattccctcctctatcgttcgtataatctatatacttatatgttccacatgaatggttaatattcctgcttatctagaaaattcatcctcgattcgcaaaatcgtttcttcaagctcttcattggctccgtccatttcaagaacctttttcaaaagcggcagcgcttctttttgaagaccttcttctaataggaagcttgcgtattcatataagaaatctctatcctcccggtaatgaagataggcagcctcaaaggattgttttgcttcctcgtattgctctaattcagtatatgcgcttgcaagataccaattgtatttaggatcttcttcaccgtagcttcgaacctcttgaataagatcaatgatctgatcataatcctcttctttgtgatacacggcaagaagtgtatgaagcgcctcgacaaagcccggatcaagcgcaagcgcctcctgaagcagcttcttcccctcttctgacttcccgattttcaaggccattttggcggcataaaggaaaagttctttgttatattcatcatatctgatcccctcttttgccgtttttaatgcctcttcatacattccttcagcttcatagcttttcgagagcggcatataaagtgaagtataagatggatcaagctcctttaaatcagacagctgcttaatagctgttttcacaagccccgcctgtaaggctgtaaaaccatagccgaaaatcgtattaggatcaggattctcatcgacagctttctcataccatggaatggcatcctcaaattcacctgaggcacttaacgattctgccagtctttgatggacattaacgcccccgatctcactctgctcctcagccgttgttttaaaatattgaaccgcttttgcataggctccctgagcaaagtaaagttctcccagtgcaaaatcaataacaggttcattgtccagaatggactttgcctggaaaagcttttgttcactgacttcgaataacccctgcatctgataaagatccgccataagcagcaaactttccggatatgatggatctgtttccggaatagtctccagcacagcgagggctttttcttcttcgtcaatatctattaaaagttcagcgtagaaattcgtcagttctgtttcatttggatataaatcatgtagatcactaatcagtgaaatggctttttctacatcgccccactcgtaataaagctgggctgcaatggctttatcttcatcatgcagctgtttttcagccttcgagagcgtgttgaggcctttttctgtttcacctgcttcaactaattttatggcttcttgaatcaatgtattcaaatcggaccggtcctttcttttcctatacaacatcaaccatacaaaaaagctttatttgttcgggttaatcttatcataattcagacgaatgcccccggcaaataagatgcttctgtacggaagggaattattgagtcttattagtttaccaaaagatcttgagatagaaaatgaaaaaaggaagatcgccctctgtacagtaaagcagctctttgacctgccggcttgtaagtaaagcacatcccccttttcgtttttctatcccctctataagacaagctatgttttttcgcctcgaattatgatctgcataaaaaatcctgaagtaaaacttcaggattttttcgaaagcttatttaaatgctcgaagaaggttggataagaaacgtgaatggcatccgtgtgctcgatttcaatcggctcctccgttatacaggaagcaataccaagcatcattccgattcgatgatctccgtggctggacactgccgcgccgcctttcaacgtttgtttgccataaaccttcattccatctgctgtcggttcaatttcagcacccagcttgcgaagctcagaaacaacagtatcaatacggtttgtttctttcacttttagctctgccgcgtccttgataacggtagttccttcagcctgagtcgcaagaagcgcgatgatagggatctcatcaattaaacgcggaatgatatctcctccgatttcaactgcctttagagatgacgtttctataatcaaatctccataaggctctgcaccgctatcagcagatggtttgatttcaagttttgcccccatgttttgaaggacatcaataatacctgtccgagtcggatttaaacctacgtttttcaatacaattctgctgtttggaaccatcgcgccagcagcaaggaaaaacgcggctgaagaaatgtctccaggaacaaaaatatcagcagctgtcagtttctggccaccagcaatggaaacactcgtttgatcttcagaaagcttaacgccaaaagcagaaagcatccgctcagtgtggtcccgagatttatggggctctgttacagttgttgtgccctcagcctgtaatccggccagcaaaacagcagatttaatttgcgcgcttgcaacaggtgatacataatcaattccttttaatgaagcgccgctcactgacagcggtgtaaactctccgccggctctgccgtcgattttagcccccatttttttcaaaggctcagtcacacgcttcattgggcgcttcgcaatgctctcatctccggctaccgcgctgtaaaaaggacggcccgccaatattccgagcatcaggcgaatggttgtacctgaatttccgacatctaaaaggctttctggctctttcagggcatcgattccttttccgtgaatcacgacatcgctgctgctttgctcaatgtgaacacccatttttctaaagcaatcgatcgtgctcagacaatctgctcccggcagaaagtttttaactgttgttgtgcctgccgctagcgcgccaaacataacagagcggtgagaaatggatttatcaccgggaatatgtatttctccatgtaaggtctgcaccttttctcgtttcattttttccacctcaatcagcataaaaagtttcatattccgcccgggcttcaatgcattgttctgcccttttgcggtcgtcatcagactgaaaactgatccttaaaatcccgttaatatcctctcgtgtttcgataatgcggatattcgtgatactgatgcgctccgcagctaagatcgctgttatctcggatattacacccggatgatcgggtacatccacatataaatcataaaatgcaggtatcgctcccttctgccgaagcggcagcccgtcgcgataatccttggcggttttaaaataacgaaatagattttccgcatcttcttgttctacatatgtacggatcttgtcaatttcacgaatccactcatcaaaacggtctaagattttatctttattatgtaataaaatatcccgccacattgccgggctgcttgatgcaatccttgtaatatctctgaatccgccggcagcaaaacgcttaacaagcggatacaggttttccgaatgatgggtttggtgaacaagactagctgctacaatatgcggaaaatgactgattacacttgtaacgccatcatgctcctccggcgacatttccacaaaatgggcattcgtacccttcagcagattttttaactgttccacagcttgtttgtctgttttctggcctggggttaaaatataaaatgcattttcaaacaggaactccttcgcagcggccactcctgatttatgtgaacccgccatcggatgccctccgacaaattgatagcggctaggcagcacttgatcagcgtaatcaaccactttttgctttgtgcttcctacatccgtaatcaaaagctcatgttcaattcctgaatgagccagcgcttcaagcataaccagtgtttgttcaacaggtgtcgcaatgattactgtagctgcctctttcgcaccgctaataaacgaatcagcacgatcgtctatcacgcctaattttaatgccgctaccgcctgttcatcagagatatcgattccgataatccgtttgccgggatgattttttttgatggctagggctatcgaaccgcctatcaatccgagaccggcgagcaatattgtatctttcatttgattcatacgtcatcacctggtttatagactaaagaggtgatattcgatcacctcttataaaatttcagctaaaatggcaagtatttcttcattttgctcttttgttccgatcgtaatccggagtgatgtcgggaaacctaatgcatttcctgaccggacgatatagcctttttccagcagagcctgaaacagttcatcagcaggacgtttaaagtcaattaacacaaaatttgtctgtgaagggtagcactttaaaccatgagttttcgcaaaatcataatactgctgaaggcctgcattattttgctcgacacaggaagcaataaacacttgatcatcaagtgcggcaatcgccgcagcctggcccagacggctcgtattaaacggctctctcgccggctcaatctggcgaatcaggttctcgtcagcaattccgtatccgactctgagcgctgccagaccgtatgcctttgaaaatgtgcgcaaaatcatcaaattggaatacttgcttaagagcggcacggtttccgggtaatcctctgctgttacatattcataatatgcttcgtcaagaacaacaaggacacgtgaaggaacgcgctccagaaatgcgagtaattctccttcagatgtataagtgccagtcggattattcgggctgcatatccaaacgacttgtgtctgttcgtcgatggcttctaacatggcgtctaaatcatgtgagccgtcgggacgaagtgcaatttcacgcacttcagcaccttcaataaccgcattatgtttatattgcggaaaagtcggggcagcagtgatcgtattggttttattgtttagaaatgcccggcagatgatctgaatgatttcatcagaaccgttgccgaaaataagtgatgtttcgctgacattgaggtgcttactgagccttgtccgcaaagcggcgctatacccgtccgggtaaagggctagctgttgaatctcatgatgaagcgcctcttttgcagcctctgaacagccgtaaggattctcgtttgaagcaagcttcacaactttatccaagccatattctgatttcactgcttcaatcggctttccaggctgataaggcttcagctgttttaaatgttctttgatacgcaaatcagtcacctcattttaaactgtacaagccgctaaacgccattgcataatcctcaaactcctgcagcgcctgatttctcgtttcagcgctgatgagccggtcctttaattcttctatttttctgacgagcgcacttcccactacgacaccgtcactaatttcattcatctttatgacctgttcacggtttgatataccgaaccctacagcgaccggaacagtgctgagattcttcactgtccgaatgaacgggtacacggatgaattgaactcattgcggacaccggtcacacccagagaagacacacagtagacgaagccctcggcttgttcaataatggttttcaaacggctttcgcttgtcggcgcaaccaaagaaatatacgtcacctcatggcttttacattcctcttgaaggctgttgctttcttctagtggcagatccggaacaagcagaccgtcaatatgattttcccgcagtaaagcgaaaaagtattctttgttcaattgtaacacaggattataatacgtaaagaggataatcggaatattcactccgttttttttcatttctccgcctaattcgattgcctttacgatattcattccttgatcaagtgcccgctttgaagcccgctggatcaccggaccgtctgcaagcgggtcagagtatgcaacaccaagctccaatgctgtggcgcctgctttttggagtgacttcgccagttcaatcgaaacctcaggaactggatcgcccaccgtaataaacgggataaacaatttttctgatggttgaagatcaaatttaaacatgggctttcacctcttcttccaatacattcattaatgtgttgacatccttgtctccccggcctgataaacagacgagaatgagttgaccgcgatccattcctttggcgagtttgaatgctttcgctaacgcatgggcagattcgattgccggcaaaatcccctctttttctgacaaaagctttaatgcatccaccgcttcttcatcagtgatactgtcataagtgacacggccgcttttatgcaagtatgcatgctccggaccgattccaggatagtcgagaccggctgaaatagagtagggctcaataatttgcccgaactcatcctgaatgagataagtcaatgaaccatgaataacccctacggttcctttcgaaatagtggcggcatgaagaggcgtatcaattccttttcctgctgcttcagcgccgatcagttcaacatcttcatttaaaaatgcctgaaacatacccatcgcattgcttcctccgcctacacatgccactactttatcaggcagagtgccttcaatacgtttcaactgatccttcgcttcctctccgatcattttttgaaattcacggaccacttgcggataaggatgcgggccgacaactgatccaatcatataaaagtgatcctcacaatgctgaacccagtaccggatcgcctcatttgtggcatccttcaatgttccgtttccgcttgttacaggcactacctccgctccaagaagcttcatgcggaaaacgttcagagactggcgggcaacatcctcttcacccataaacacagtacaggaaaagccgaatttggctgcaactgttgcagcggcaacaccatgctggccggcaccggtttcagcaatgattttcgttttgcccatttttttagcaagcagcgcttgacctagcgcattattgattttatgagaacctgtatggtttaaatcttctcgtttcaaatagattttcgcgccgcctaagtattcagtgactcgatcagcgtatgttaatgcagtcggccgtccggaatagtcctttaacagcttataatactcttcacgaaaagcggggtcatccttgatttgtttaaatgctgtttctatttcatctaacggctgcatgagtgtttccggaacaaactttcctccaaaatcaccgtatctgcctatttcattcggatatggatacatatcggttcatcctttcttctaaaagcctcatcagattctgatctttttgtccgtttttttcaattccgctggcaaggtcaattccttctggctgccatttcaataggctggtgatgctatccggattcacgccgccagcgataaagcagcgtttaccaatagccgcctgctgatattccggcacacattcccaagaaaatgcaacaccagttccgcctctagacccttttacagatgaatcaatcacaaagccgtcaacattatctttaaagcgggctatttcttgagttgtgttaccttgatggtgaagcgccttccatatttcacagcctgtcagcttgcgaagagcagcagcatccgccggtttttcatcaccgtgaagctgaatgacgtcgagcttcaagctcttggcaatacgtgacatcgtctctattgattcattaacaaaaacacctgcaacctgtttttcgacacgagcttggttcagccattttttcacatcttgcggagatacttttcgtttgctttcagcaaaaataaatcctaggtaatcagcctgtgattccgccgcaagctgcaaatcctttagtgaccgaataccgcaatattttaatgccggtttcttcacaacctcactccccaaacaaagcatggattgctttacgctgagaagtttgtctcatcaatgattcaccaataagtacagctcgcgccccatgttcattgacaaatgttaaatgttctaaagaaccgattccgctttcgctgacaagcaaggattctttcggaacgagagatgcgatttgttctgtctgctttacagatgtttcaaacgtttttaggtttcgattatttacgccgagaatgtcgggtgtgaacactttcaatatttgttctagcgttgatgcatcatgaacctccactaacacgtccatccccttttcacctgcttcaagatataattcatgaaggtgtaagggatcaagcacctcgccgattaacaatatggcatccgctccgattcttcttgattcctctacttgaagagaatcaataataaaatcttttctaagtacaggaatcgaaacagcacgctttacgtctgataaatagctgttttccccttgaaaaaacggggtgtctgttaaaacggaaatcgcatctgccttcgcagcctcatagtcttttgcaatctgcacaggcacaaaattctctttaataagcccttttgacggcgatgctttcttcacttcggcaatcaacccgataaaccgattcgggcttgccagcgcctccttaaatgaacgtttctcgaaaggctgctctaccggcaaaaccagtgttttcacttcttctttcttttgtttgatgattttttcaagcatagatctcttcctctttctgctttagtcgttcaagctgcgcggcagcgcctccgcttgtaatcgtctctaacgccagctccgttccttccttcagtgaggcggtaatccccgccgtgtaaatcgcagctcccgcattaaaagccgtaatagataaagcggaactgctgcttttattttcaaaaatattctgaatgagataggcgctctctttcggtgactgcacctgtaaatcttcaagtctgccatttgtgaaaccgaaatcttcgggtgaaacggtatattcccggcgctctccgtcctttaattcaatcacgtcggtcggtgctgtaattgaaagctcatctaaaccgtcacggcttgatacaaacatgacgtgcttcggctgaaacgtctccagtgcgcttgccatcagtccagctttttcaacagaatagaccccaatcacctgacgcttcgcctgtaaaggattgctgagcggcccaagcagattaaataccgttctgaaacctagctcttttctagtacctgctacatgtttcatagacgaatggtaaagcggcgcaaaaagaaatcccatgttgtttgtttcaatgctgcttttgaccttctcgggagtggtttgaatagaaacctctagctcctctaaaacatcagcgcttccgcttttagaagagacagagcgattgccatgcttagcgattttcgcgccagctgccgaggcaacaattgccgaggcagttgagatattaaaagtggaaataccgtctccccctgttccgcatgtatcaacaatatcaggaagtccatcgactgtaagagcgtgtgcccgcattgccttcacaaaacccgcaagctcttctggcgtctccccccgatgagcaagaatagacaatataccacccatttccgaaggagtcatttccgctgccatcatcatattcatcaacgtttcagcctcaccggcagtaaggttttttccgtcaacgcacaattgaagaaatttgttcatcagctttatcctccttgctatgaaacatgtcttctgcaatatgaatcgttttcagcagcgcaccggctttattacagctttcttcgtattcggcttctggaacagaatcagcaacaatgccagcacctgcctgtatcgatgcaacgccgttctttacactcatcgtgcgaatcgtaatacaagagtcgatattcccgtcaaacccaatgtaggcaatacaccctccgtatgtctctctcggtgttggctcgagctcttgcaaaagctgcatggcacggattttgggtgcgcctgttaaagtccccgccgggaaagcagacatcagtgcatcgacaggatgaaccccttttttcaatcggcctgtaaccaccgagataatgtgcatgacatgtgaaaaggagacaatttttgtgaactccggcacagaaacagaaccatactctgctactctgccgatatcgtttcgggcaagatcaacgagcatgtaatgctccgccttttctttttcatccttcatcagctcaaccttcagtctctcatcttcagctttgtctgcgccgcgttttctcgtaccggcaatcggatggatttctaagtgcccgtcttgaacgtgtattaaccgttccggagagctgccgactatttctctgtctagcagtttcatataatacatatacggcgaaggattgacgatcctaagcactcggtataactcaaaagcatctgcttttatcggcacctcaaatttttgtgataaaacaccctggaagatatctcctgcttttatatagcttttgattttttctacatcagccataaaagccgatttttcataattagaagataccgtctcaaagctgggtgtcttgtatgaatcagcagagagaaacagctcttttatttttttttggtccatcattttttcgatgagattttggagctccaaatgattttgatggaatacatccattttttcgttttctgtttcctctccagtgagccttgcatattggataaagtggacgtttttggtttcatgatcatacgcaattaatgtccggcaaacaaacagcatgcacttttccatgtctgtttcttttgtatgcgaaggaacagaaggctcaatcagcgggatcatatcatagcttaagtacccgacagctccgccgacaaaaggaatgccaagctgaggtgttttgattttgtatgtggtattcatccagttcagcacttcttttagttcatttcctgtgtaaagagatttgctgtcctgatcagcggccgaaaaacggccctgctcttctttaattgtgagaaatggatgcaggccgataaatgaatatctggaccaagtggatgtatcgtcctggctttcaagaagatacgtaatctccctgtcaagcttctctatcatttgaatgggtgtcagtgtatcgactgtgaaggtctccacaatcggtatcgtgtggtgggacaagctgtcctctaaaaatgcggaaatgtttgattggaaattcattactctcactccttatggcaaggagaatgagaagatggcatgagaggataaaatactatataacaaataaacccaaaagaaagacttcttttgggtagaataaacataatgtctcagctcaactaaactcattctctgctaccctattctctaactcaactcattctaattgctttatacacactcttgtgtatttctaagctgttcttatcgtattacaattcagtattttttgtcaatgataaatcgggcctcaatacgacggctttttctaaatatacatgtctgatctgatcctgagggacatctgtctggaccgtcatcatgactcttatgcactttttcagaccgcctgttacgtccatttcctgcatacatgttaccggtacatactgccatcctgaaagctcgcgaacagcttttgccgggaaaacagcgtgcaaatcaggtgtagccgacagaagcatttgaacaacatcttccggttttgtatgattttcttctatgattttctctaacagctgtttagttttttgtaaaatttcttcttcagtatcccgttcaactgtagttgctccgcgaattccgcgaatcatcatgatgtctcctccaatcgccatttgttcagccagctctcaagttcatttctggaaaatgtatgatcagcaactttccctaattcgttgagcacaataaactgaatcttcccgccacgggttttcttatcattcatcatacggtccaagagaaccgaagtttccgtctcttttctgatttgacttggataacccaggctttttagccagctgaccaaacgttttctgtccatttcacagcctacagtcttttcgcttatatataaagcaaactgcattccgagggctacggcatcaccgtgagtgatctgcccgtatccatattccgcctcaacggcatgaccgagcgtatgcccgaagtttaagtaagctcttatcccctcttctttttcatcctgctgaacgacagacgctttaattgaaatgcctttaaaaatcatgtcattcagctgatcattagtgatatcacgcagtgagtggatattcagcaactcctccagaaacgctctgtcatagataaaagcgtgtttaatcacttctgccattccggacctaagctctttttcaggcagagaacgcaggaaatctgtatcatagagcacggctttcggctgataaaacgcaccgattagattttttccaagcggatggttcacggctacttttcctccgactgcgctgtcatgcgccaagagcgtcgtaggcatttggatgaaatcaatgccgcgcataaaagtggcagccacaaaaccggcaagatcccctacaacaccgccaccgaatgcgatgatgcatgaggagcgatccaaatgaaaacgaatcgcttcactctgcaattttgtgtacatgtccatggattttgcctgctctccactcggtaccgtcacttttttcacaggccatttatcttgcagcaaatggagcatttcatcaccatacaggcggtccacttcttcatccgtgacaagcataatccttgttaaaggcctgtttaaagaggttaatagttcgcaagccttttttctgataccttgtccgataaaaacaggatatgacgaggaagcagtttgaacatgcagtgtcttcattaaaattccctcgacagttttctcatattctccacattttctctaatgcggtcaatttgatctaatccgaattgttcaacgactgcgttcgcaatttcccaagcgacagccgcttcagcgactacacttgccgcaggaacagcacagctgtctgaacgttcaatgctggcagaaaacggttctttcgtttcaatatcgacacttttcagcggtttatacaaagtcggaatcggcttcatgactccgcggacaacgattggcatccctgtcgtcatgccgccttccagtccgccaagtctgttagtagcacgggtgtatcctttttcctcgtcccaaatgatctcgtcatggacttcgcttccatttcggcctgccgcctcaaatccgatcccgaattccacacctttaaatgcattaattgacagtacagcggcagcaagcttgctatccagtttgcggtcataatggacatagctgcccacgcctaccggcattccctcgacaatgacttctactattccgccgatggaatctccgtttgcctttgcttcatcaatggcagccatcatttttttgcctgcctcttcatcgtagcatctgacaggagactcttccgttacgcgctgcaggtcttcaattgacgtatattctgttttttcagctttaacagcgccaatttgcaacacgtggcccgccaccttaatgccaagctcagaaagaatctttttagctacagcccctgccgccactctgacagttgtttcccttgctgaagaccgctcaagcacatttctcatatcacgatgattatatttaattgcaccgtttaagtcagcgtgcccaggtctaggtctggaaatctggcgcttcatttccttttcttcatcttctgtaattggagcggcgcccatgatttttgtccaatgcttccaatcgttattttcaactacgagagcaattggtgaaccgagtgtacgtgcatggcgcaccccgctcataattttggcctggtctttttcgatctgcatgcggcgaccgcggccgtgtcctttttggcgtctggcaagctcaaaattgatatcttcctccgttatgtaaagcccggcaggtacaccctcaataatggttgtcagttgggggccgtgtgattctccggctgttaaatatctcatgacttcttctcccttcatcacattaacgcttttaagtaagactactataacatatttttcagcaaaaagtcagtctatcttttttgataaaagaatgtatcggctgggactaggccaaatttctcgggattgaagatttgctcggtgctgccgacaaaaagaactccattcttcttcaagctatgtgccatttttaaatacagctcttccttcgcgctttctgtaaaataaataaatacattgcggcacacgattaagtcaaagtcttgttcataacgatccgccagcaaattgtgctttttgaatgtaatattctttttgatttccgttttcacttcataacttctatttgcgttttgcgtaaaataacgatctttcacagatagcggcacttcctgtaaagaccgctcctgataaacgccttttttggctttttccaaagctttttcatcaatatccgtcgccaaaatctgatagcccggaagacctttttgctggtccaaaagcatggcaagcgtgtatggctcctcacccgttgagcaggcggcactccaaatctttaaaggcctagaggtcttgattaacggcagaattgcagtctcaagaacttcccatcttttataattacgataaaattctgaaacattgatcgtcattctgtccaatgtttcatttaagagagcttgatccttttccaatgccgccgcaaagtccttaaagctttggaacccctttttctcataaagtgacgttagccttctcttcatttgtgcttctttatatagtgtcaaatcgactccggttaattgtttccattttgttgtaaatacgctgtatgtatccatctctactctcccagtctcgctgtctttttgtcctagtatagcttgttttatcaggaaattgtattgtttcaataaaaaaatcagcttttcagctgattttagatcgttgggaaaggcagaggtctgatgcacactgccaatcaaccctttattcactttaatgtaaacctttacaaaacagatcaaaaaccggcggcgttatatgttgccggctctgttgcttattttcacaatgattaatagatccagcctgccataagctgctgatatgatactaattcttcattcttaaagaaaatgttaatctcgcgttctgcactttcgagagaatcagagccgtggatgatgttttttccgacaaacatgccataatccccacgaatcgtaccaggtaaagcttctttagggtttgttttcccgatcagctgtctcgtcacttcaatgacattttcgccttcccacaccattgcgaatacaggtcctgaagtaataaactcaacgagctctccgaagaaaggcttaccttgatgttcggcgtagtgtttctcagccatttgttcagtcactctcattaacttggcgccagctaattgtaagcccttacgttcgaatctagataaaatgtccccaatgagctgacgttggacaccgtctggtttcaccatgataaaagtcttttccatcatattctccaccccatcattatgtatgtataggctttcacactgcacaccgaaatcgtaacatctttctgataattaatcaatccggggcggagaaatttcttaatatctacaaaaattaaaattttcttttaccgatatattttgcgatggctgcaagagacgagcgtgcgcgccctcgaggaagcgtgtttaatttctgaaaagctttctgcagatacatttcgcttactgccatagatgcttcaattgcatctgtttttttgatttcttcaatgattggttcaagctgttcctgcgttgtctcactgttaatcaatttaagctggttttttaatgcaggatttttcagggcatacagcactggcaatgtgacgtttccttgaagcaaatctcctcctacgggtttacccagctcttcctcagttgaagtaaaatcaagaatatcatcaataatctgataagacatgccgacgtaatacccaaaccagtacaatgccttatgaatcttctcatcagctccagacgcaatggcaccaagctggcagctgaccgcgatcaagagagctgtttttcttttgatacggcggagatacgttctgagattttgttccatgttgtatttgtctttgatctgctcaatttcccctagacaaacttcaacgatcgtctgtgacaaaatcctatgggctttcggttcgttaattctcgtcatcatttcaagagatcccgcaagcatataatcgcctgtgtacatcgcaatacgattgtcccactttgctttgattgtcggttttcctcggcgaagctctgcatcatcaatgacatcatcatgaaccaaagatgccatgtgaatcatttccagagtgacggcgacatatttaatcttattaatatcgtaatcgccaaacatgccagaaagcagcacgaaaacaggccgaatacgtttccctccggcctgcagcaggtgaagacctgcctcgcttaaaagcgggtaatcggaacgtacggtttgttcaagttctctttcgattacatcaatatcgtcatttaaaaaagagtaggccattttaaatttcatatcattcacccaaacatctgtgttttcatttccatccgatatgcgtggcagcgactccgccagtaaacgaatgatatttaacatttttcaggcccgcctcttcaaacaggcctgccagttccttcattccagggaaatctctggctgattcttgaagccaagaatattctttatagctcttcgcaaacagtttcccgaaaaacggcataatatacttaaagtacataaagtaagcctgtctgaatccgaacatttccggctgggacgtttccagacataccacctgcccacccggcttcactacacgtctcatctctttcagtacagtcaagtaatcagggacattgcggagtccgaagccaatggtgacataatcaaatgtatcatcatcaaaaggaagctccatcgcatttccgtgcagcagttcaatttggctgaatccgccgtcttttactttctgctcgccgacactcagcatattttcactgaaatccaagcccttgatctcgccgcttttgccggccgcttttgcaagagcgatcgtccagtcagccgttccgcagcagacatcaagtgctgttgcgccttcttttacattcatgatgcgcatcgttttgtcgcgccattttttatgctgctgaaaactgatgacagagttcatttggtcatagtttttatatattttttcaaatactccgtgtacgcgctgttcttttgagtcctgcataatggtttacccttcttccactttctgatgataggtttgatcttggctgattgtcttcagacggtttattaaaatgttctgaataggtgaatttagaggcagaagtgactcaatgctgtttttcgcttttttaaaacaatcttctaatatctcttcttttgtttttcccagctgtataaaactcccgatcacatccagaaatgcatcatttccgttcataagccgcttaaatacaaaaaaatcactcgacagctttttccagcgcggaaggttgaagtgttccgccacacgatggaataaagctgattcaacgatgccgacactttcgaaaaaatcgttttcgtccttgaaagaacggtcatacagacgaattttatgttcgttgatttctttaatggctgtagcaagcgtccgaatcatgtagatatccttcatttcagatagtaaagagtagtacagcccgctgaaataatcgcccgcgagaacagtcaattggcggtttttgttttcgtctcgttttatgactctagctgtcgtcacttcatcatgggtatcaagggcgctttgtacaagcatcgctgttacaatataattttctctgtcgttgttttttatgtcagcttcttcaaataaagcatgaaaaagaagaagcttatcctcatcaattttcggcgcggaaatatgcttcgctaaataaggatgagacagcttttgttttaatttcttgttcagattggctaaagttccgtagatgtcttgcaaaaatatcacccttgtccccaaattcacatttatttcttaatctatgtatgagttttatcttttcattcgcttacgcaggtatcattatagcataaaaaaaagaaattggctgtatcctcccgctgtttgcgagcatttgcttttaacagcggggacagccagcttattttttttcgcttttcatttctccgtacgcggtttgaatcagtgcctctcctctgactttaatggcagaagtatgctctgtaaactgagcgatgatcacttctcccttgtcgagtttttcggaatggtgaaactttgtgtctgttcctcttgtcaggccgatcacattcactccgtcctcaacggctttaatgacgacaaaatcacttgaatgcttttggttcatttatagcaccctctatctttattagtcctggcgtttaatatgttccaatacttctgcacgggcagcggcatcatctttaaaaacgcctctgactgctgaagtcacagttttcgcacccggttttcttacaccgcgcatcgtcatgcacatgtgttccgcttcaaccactaccattacgccatgcggatcaagcgtttctacgatgctttctgcaattgtagaagtgatgcgttcctgaagctgcgggcgctttgcaacggcttcaacggcacgtgccagtttgctgagtcctgtgacctttccgcctcgcgggatatatgcaacatgtgcttttccataaaagggaacaaggtgatgctcacacatagaatgaaacgcgatatcttttacaagaacaagctcctcatggttttcaccgaagatagtctggaaatgttcttttggatcttcattcaagccggagaatacttcggcatacatctttgcgactcttttcggagtatcaagaagcccttctctattcgggtcttctccgatcgcttctaaaatttgacgaacagcttgttcgatttgctctttattaacttctttcatgttctatgtcctccaccaatgaatacatttaatttcgattctagcacatatgccccgctaaaagcaaagtgaatgccctgtcaggaagcccatgctcttgaaatatgaaaagccccttagaaaggggcttttctgtgaagaaataaagtgtatgtaagctagatgcatacacgatctatattcacaattattttccggcaactgcgtctttaagcgctttacctggtttgaaagcaggtactttgcttgctggaatttcgatttcttcacctgtttgaggattgcgtcctttacgtgcagaacgttcacgcacctcgaagttaccaaaaccgatcagttggattttatcaccgtttttaagtgcatctaagatcgtatcaaaaacagagtcaactgcttttgtagcgtcttttttagacaattcgcttgcttctgcaaccgcattgataagttctgttttgttcatgcctttcacctcctcccaaaaggatacattcagttcgtttattatcatttcttcacagttcagtctgattctaaacctgtctcagaaaaaaatgagagcaagtaagagaaagacaattaaacggctttttaagaaaaactgcactctgaggaatgtttgtccaacaaagtgaagaatttctgtatgtagagtaacacatataaaaagccatatcaagcattttaaagcgtcaatcccttgctcgtcaaggatttaaggtgatttaccgaacaaatattcctttttttccttttttcatcctattccttgatccttttccattattaagaacaaagaaaaaagacctcccattctataaagaggtctaccggtattacaggatgatggcgattaagccgccagagccttcgtttatgattctttctaatgtttcttttaatttataccgtgcgttttcaggcattaatgacagctttgcctgaatcccttctctcacaattgagctcagcgaccttccgaagatatcggaattccagatggagagcggatcatcctcaaagtcctgcattaaatagcgtacaagctcttcactttgtttttccgttccgataatcggggcgaattcgctttcgacatcgactttgatcatatggatcgacggagcgacagctttcagcctcacaccgaatcgtgagccctgccttataatttccggctcatcgagactcatatcagctaaagcaggcgctgcaatgccgtatcccgtctgtttgaccatttttaaggcatcagacacttgatcatattctgttttcgcatgggcgaagtcttgcatgagctcaagcagatggtctcttcctctgatttcgacgcccacaacttcttttaggatttgatcatatagatgatcaggcgcgtacaaatcaatttctgccaccccttggcccagctcaattccggctaatccggcactttcaatgaattcaaactcgctgaattggccgacaaccctgtctacgtcccggagccgtttaatatccttaaccgtttccttcacggactcctgatagctttcacgcagccaatggttttctttcagcaccattacccagcttgggagattgacattcacttctagcaccggaaactcgtagagggcctctctgagcacactcagcacatctgattcccgcatgctctctacactcattgccaataccgggatatcatatttttcgcttaaatcctggcgcatggcttccgtttccgggtgatacggcctgactgagttgatgaccataataaaaggtttgccaacctctttcagctcttcaatgactctttcttcagcctctatatagtcacttctggcgatatctccaatggtgccgtctgtcgtaatgacaactccgatggtcgagtgttcttgaatgacttttcgagtgccgatttcagcagcctcatgaaatgggatcggttcttcgtaccaaggcgtattgatcatccgcggcccgttttcatcttcgtatcctttagcgccgggcactgtgtaacctacacaatctactaatcttatattcacatcgagtccgtctgacacatgaacagacatcgcctgattcggaacaaatttaggctctgtagtcataatggttttgccggctgcgctctgcggcagttcatcctgcgctcgggcccggtctgcttcgttactgatattcgggagcaccacaagctccataaattttttaatgaacgtggattttcctgtacggacagcacctacgactcctaagtatatatcgcctcctgttcgttcagcgatatccttgaaaatatcgaccttttccaagtgatcccctcccggacttcctatccttttcaattttattaagctctttcaatcaaacacaggacactatatgtgtatgacgttgtcctatttgaatatgacatctttagaaaatttctcatcctcaatctattaaagtataaaaaaacctttctccctatttgtatgcaagggagaaaggttcattcctttttcatatcattttctaaaaaaacaggttcctgtttgtcatttaccgtatattttacagaaaacgcggggacaaagggggtatcctgccaaatcatatcctggatttcagtcccgggtttaaacgtttttttgctttttttgaggcaagaagccagctcagtccggtaatcggcatatatttctccgtctccgtcaatcataagcggcaaggaattccctgagattgggcttgtcactgtaagagagcttccatccccaagcttcttctcatcgagtgtaaataaatcacgagatagcacatccttgtaaggcggatattgatgctcctgacgatacatttggatgcgcaatttcacatcgcgaattttttctgccatctttagatcaattaatttaacagtcggatcgttctctacgtcaacaagcacgtattgatagtctcccccgctttcaaatgccgtacttggaggttcagctatgtatcttggcgctaaccggttaaagtctatcggatatttttgatatagcggtgtcgacatatctttggtttgaataggaagcagccctccatttgccttttgaaattcatcaacagcagattgaacctgctttagctggtcttgataaggaatggcatgcacactgcttttccgttcatttggatataaacatccggataaaaacacgactgccgcaaaaatgattgcgcacttcagtttacccatacagcacttccttttacagctttattcattgacagggccgctaaaaaccacgacaaacacaataattccagatatgagcatacacatgtatgcgaatgatgaaatcgcaatcttcaaaaaacggttttggcacttaaagcggcttaaatagatggaagctacagccagaaacatcagacccatggaccctagagcaaaccacattttcatcaatgccagattcaatgacgtgcgcctccccgatatgtatgatgtaagcgttatattatattttaatatacagcgccggaaaagatcaaccagattttccatccattgatagaacaaaaaaactgaagcaaagagggggaccttcgcttcagtcaacttgactatattcacctgcacgtttaagaaacactctcttggacttcgatgctatagtatgcgacttggcatacagatgcatcctctattgcctaaatcggcaaaatgtttcaggagatcccaagacttgggtgttcttctgtttttcgggctttcgttcaattaagatatgcgtttcatcataccattgacacttttacttcacttgattttcaaacgtatttaccaaatcctccatctcgtgggttttccctcttgccattaaagattcaacagcggtttccactttttgtccgttgaacaggacctgatggagagcttctgtaatcggcattttaacatcatatttcttcgaaagctgataagccgctttcgtcgtgcggacgccttcgactaccattcccatctcttcaagaacatcttcaagcttgtacccttttccgagcaaattgcccgcacgccagtttctggaatgaacacttgtgcacgtcacaatcagatcgcctactcctgtcaatccagagaacgtcaagggatttccgcccattttcgttccgagtctcgcgatttcggcaagtccgcgtgtaatcaaagcagctttggcattgtcgccgtaccctaaaccatctgtaattcctgcagcaagggcaataatattttttaaagcccctccgatttcaactccgataatgtcaggatttgtgtacacccgaaaattgtgattaataaatagatcctgcacctcttctgctgccctcatgctctttgaagatgcagtaacagttgtggggtgccgcagccctacttcttccgcatgactcgggccggaaaggacaacgatatcttttctgacatcactcgggagctcaatttccataatttcagaaatgcgcagaagtgaatctggctcaatacccttgctgacatgaacaaagactgcctttttcgttataaaagggacagcctgtctcagcacttcccgaattgcttttgtcgggaccgcaacgataatgaaatctgcgtctgaaacagcctctttcatatctgttgttcctttaatggatgtagacagcttaacattcggcaaataatctttgttttcatgcaactcattaatttgatgaattaaatctgcacggtgagcccacacacacacttcatttccattatcagttagaactaaagccagtgctgttccccaactccctgctccaagcattgtgacttttttcatgtttgattcacacctttttattttctagctcttgcaaatattttgattggtgtcccctcaaaaccgaacgcgtctctgattcggttttctaaaaaccgttcgtatgaaaaatgcatcaattccggatcgtttacaaacacaacgaagcttggcggctttaccgacacttgagtcgcatagtaaatcttcaaacgagaaccgttatgagtcggtgtcggattcattgccacagcatccatgatgacatcatttaagacgttcgtctgaactcgaagtgaatgattttcacttgctttaataatcgcaggcatcagcgtatggatccgttttttcgttaaggcagacataaataggattggcgcataatccagaaattgaaaatgatcgcgaatattttcttcaaattctttcatcgtgctctcatctttgtcaacagcatcccatttgtttacgacgatgacgacggccttgcccgcttcgtgtgcatagccggcgatgcgcttatcctgttcaataatgccttcttcgccatccagcacaaccgccacgacttctgagcggtcaatcgctttcagcgcccgcagtacactatacttctcagtcgtttcatagacttttcctttttttcgcatacctgcagtatcgacaatgacaaactcctgctggttgtaagtaaatgacgtatcaacagcatctcttgtcgttccagccacgttgctgacaataacgcgttcttcgccgagcatcgcattcacaagtgaggactttccgacatttggacgtccgatcagacagaattgaataacttcttcattgtatttcgtttcaggaatgtttttaaaatgctctgcaacggcatccagtaaatcacccagtccgagtccgtgtgttcccgaaattggatatggctcgccaaagcctagcgaataaaaatcataaatattcgctctcatttctgtgttatccagtttattaaccgctaaaacaacaggcttttttgtgcggtacaaaattttcgccacttcttcatcagcagctgtcacaccttcacggccgttcaccataaaaataatcacgtccgcttcatccatggcgatttcagcctgctggcgaatctgcgctaagaacggctcatcaccgatatcaataccgcccgtatcaatcaaattaaaatcataattcagccattcagccgagctgtatatccgatcccttgtcacgccaggggtatcttctactattgaaattctttctcccgcaatccggttaaagattgtggattttcctacatttggtctcccgacaatggctacgacaggtttacccatagtacccttcctttcaatccagccgctttcatttttacataaattttcaaccggttattaaattcatttcattcacttttatgaaaagaaacccttcagaggaagggcttaactcatttattatatcagtttttactgggatcacaactattcttaaaaatgtttcacgatcaaatacacgtcatctccgattctgtgagctattccatcaaggatcgcctcaagatttttagcgaaaagctccatctccttttggtcattgcaaaaaaagacaggtgctccccctgcaacccggtttggatttgtcgtgattacagacaaaatcactttcgtaagagattcactcatcctatcaccttatcctgattcttgataaattcagtcggcattctaatcgcattttccaaggttggaacattgctaataatttgaacagccgtttcgggatggtgaatttgcgggagaacaaatactgccactctcccatcatttaaatcccgttttgcaattggtgtcaaagatggctctcctgaatcccgataaaccccgagcacattggaaacatcaaataaaatggcctgacgctgccctaaatttgctatcgtcgctgctgaattaaagtttttcggcgttaaaataaagcccatgccatgctttaaaatcagttcctgtttctctggaagcccgatattcatcatataaatattatcaacaaacagtcccggaccgtcaaagcgcggctttatgtactcgatgtctacaatatccttcaacacactgcccgacataaatttcatggccagtaaaaaacaaacgacagccgctatgacagcagcccagatggataaaaacacatacgcagaggttgtcaaaagcgctgtaaagatcacaatataatttctgctttcaaacgcaatggcaatcccctcaatatatgtgctaccccttgagacaagttcatacgaatccatttgcgtcaatgtgttccgctccatgtttcggacatctctaaattgcgtcgctgccaatgttaaaaatgtgatggccgtaaattcctcctgcaaaagcgccggcataataattgcacctaaaccagccgctatcaaccccagtgcgatgtgaatcactttcccatgaacataggtcggatactggcggtaatccgttttcagcatataaagccttgtcgcaattccggcaatgaccccaacaataatcggatagatgtaatcactcatgacattttggtagctcctttgtttgatcttttgcttttctgaccaatctggcttgcgaggtattcgtatttagatatgccaaacagcaatatcatccccgcagaacacgcattcagccattgaaagccgccgacagccatagccccggccaacttctggatcacaaatgaatacaccagttcgccttggcacatccctaggacaaataagacaagctgcttctcaaaattcctatcaacagaagctgttaaaagcactattaatataacagcagcccactcaggttttatgatgaaccaaaccgggtcatataatgcaaaaagataaacaaacgcatacgcggaaacaagcgtcagatagaccatgatgtaacgaaaacgatacattcccaaatacccggcatagacacatccgcaaacgaaaaacatcaaatatgcagcattcagggaaaaatataaagcgatgtcatgtatgcttagaataatattagttaaaataaagacagagacggcaattcgtcttttcgtcttttcaaaaataaatgttgtcagaacccacagaaaccacattgaccaatagtaataaaattgttccattttacttcctccatattcccagtatggagttcaagcacattttttaaacaatcgatctcatattaaggagtatgatcatgggaaaagacagacaagagaaaaaactcaaagcttcaggcagagtcgaatcagaccgcgaccagtccattcactatgacggagcgacaagccttgaacaaaacggaagattcaaaaagcgaaaatcataatacaaaaagcccaaaccacatatggttttgggcttttatcatttatcgcacactatagcttgatgtattgatccctctctctgtgagccaatgatgggtttcacctttgatcacaaggggcgccttttgtaaatcggcaatcgttctggtgcccagcacggtcataatcatctttaattcctcaaggatcagctgaatctcctcaagcagtccttcctcaccgctgtcagtcagggcttttaaaaaatgccctgccattccggtgcaagaggccccaagcgcaatggcctttgccacatcaagtgcatcttgcagaccaccagaagcgatcatggtgcttgcaggaaactcggagcggatttccgccaaacttgcagcggtcgaaatgccccacgagttaaaaaaggagatttgccgctgtcttcggagattttcgattttcgagaaatttgttcccccgtaaccgccaatgtcaacagctgcagcaccagcttcatacagctttcctgctgattctttgctcataccgaatccgacttctttcacaatgactggtacgctgacatgactgcaaatttgttcaatgcgttccagtgcgccgctaaagcttctgtctccttcaggcatcacaatttcctgaatcacattgaggtggatctgcagtgcgtttgccccaatcatctcaacggcttcctttgcctgggcagccgttgcctcgcttcccaggttggcaaaaatcagcccgtttgggttttcctttcgaacaatttcataggaaagacgctctgatggatcttttaatgctgacatttgcgatcccacagcaaggggaattccagcctgagaagccgctcgcgcaagcgatttattaatctcatatgtaagttttccaccgccgccagtcattgcattgataaaaatcggcgaactgcttgaaagttcgccgatttttgtggaaatatctacttgttctaatgcaagatcgggcagactgacgtgaacaaacgtaatatcatcaagacctgtttcccgcttctggccggtggacaaggcatgattgatgtgttgtctttttcgttctgctcgagtcacgtttatcaccaattattttagtttattcagcttatctccgatcagatctccaagctggaagccagtgcttgtttcttccttcgcttgatattgacggtaatcttcctgatcagctttaggcgtttcttcaagttcacgcatgcttaatgaaatgcgctcctcattttcattcacatcaagaaccttcacttttacagtctgtccttcttcaaggacttcatgcggcgtgccgatgtgtttattggaaatttgagaaatatgaacgagaccttcaacacctggaaggatttcaacaaaggcaccgaagcttacaagacgctgtacagttccttcaagcacatcgccaggcttcactttttcgccgatttggctccaaggtccaggcagtgtatctttgattgataaagaaatacgttcgttgtcacggtcaaccgataacactttcacttttacttcttgtccctcttcaacaacgtcagacggtttctctacatgagagtgggaaagctgtgaaatgtgtacaagtccgtcgatgccgccgatatcaacaaatgcgccaaagtcagtcaggcgctgtactttgccatcaagtacacttccaacttcaagagactgaagaagttcttgttttttattcgcttgctcactttcaacaacagcacggtgtgaaaggatcacgcggtttttatcacggtcaagctctacaacgagcagtgacagtgtttttcctttatagtcagtgaagtcttcaacgaaatgtgcttcaacaagtgatgccggaataaaaccgcgaacgccgatatcaacgacaaggccgcctttcacgacatctttcacttcagcttcaaacacttcttttgtttcaaattttttctcaaggtcttcccaagcgcggtctgcatcaacagcacgtttagataaaatcaaagcatcgtcttccacttttgttactttcaggtcaagctcgtcgtctactttaacaacatccgatgctttctctacatgaagacttgataattcactgattggaataataccggattgtttgacattgatgatttctacatctacatgtttgtcttctacctttgtcacaatccctttaactacatctccaacctctggcacttgaacatcaatttgattcatttcctctgtcatttgaataacctccttggtccaaacctacacagcttaattaaaacggtttgaaagctgaacatataacatgcccgcttttagccgaatatgtattaaagaatcatccaaaaaagttttttgaatgatcaataaaaagttttattagtattaacttctaataaaaggacaggtttgtcaagcaataacattctatcttcgttgaaaaattcaaaaaaagtggcatttgccatcctcagcgggacttttgctccacagcctcgaggattttatcagctacctcttgaatggaaagcgatgtcgtgtcgatttcaagagcgtcttctgctttacgcaacggagatacttcgcgctctgaatcaagcttgtctcttcttgcaatttcctcaattaatgtttcgaagttgacatcaaagccttttttcacattttcttcataacgacgtttcgctctctcttcaacagatgccaaaagaaagatttttacttctgcatttggcagcacatgcgtcccgatgtcacgaccatccatgacgacgccgcctttttccccaagctgctgctggcgtttcaccatctcttctctgacacttctgtgcttggccgcaattgaaacttggttgctgacttcatctgttctgatcgcctcagttacatcggtgccgtttacaagcactttttgtccatcttttgttgtaatcagctcaatgtctgtccgctttagcagctcagccagtttttcttcatctgtcagatcaacgttttcctgtaaagccgcgtacgtaatcgcccgatacatcgctcctgtatcaatatatatgtacgattttttctcagccacaattttggcaacggtgcttttccccgcagctgccgggccgtcgattgcaatcgataatttcttttccataattcctctccttgctcttttctcctctatggattgtatcacgaactttatgaaaaagggtgaaaaattgatgaataattaatgtttgaaggtttcaatcctattgttttcctccattttatccaccccttcatattgaatcacttttgatacgtatggttcaatatgctgatagtgaaaaagaaattggacaccaagtaaaatgatggcctgaatgaacaataatttgatcagcagccgttcaaatgttttcattggagcacctccattacaaatagtatggaagtgtttgccgatgtttattccattcgggcctttcttctcttatttaactggcgcctgatgcagtattgaagcaaagcctgctggtcacctgctgcaatttctgaatactctaaagtcatttttcgtttttctgacttggggtcattaaagattcgtctgacaactgcttctgtttctatttgacgtgtgtgctcctcttcaggaagacggatgatcaggcgcaatgattcccccgattgaaaagaaaggccatcagctaaaaccacggcgatgccgcctgcactgatgttataagatagtgtgcggatctcttcctcatttcccggctgaatttgcacatctaataccgcatcagttcttacatattggcggcgctggattcttttcattttttcacggggaggcacttcaagacagatcatttgaagtttgtccttcactttaccttttatacggcttataaagcgataaggaacttcgtcttttcccacaaactctaccgttacttccatatcgttatgtaaaatcacagttcgccctgtaactacatcaacaggatacgcgatcaaaagttcattgttttcgatgctgaccgccttgctttttgcctttttcaattcattttcttctatatattctaaaagtacagtttctccaatctctatcattgacttcactctttcgcattcaatatactcacgtttttattaaagcacgtaatgaaaaaaaggaaaagacatttagtcctttcctcctgttttttataggtctttatatataggttctgcattttttagtttttcaaccttttcttccgatccgtctttggcattgatatacattctgaaagtgtcattttcaattgttccaagcatttcgtaacataacacttcttgacctagttcatttgtaatcaaagcgagccttgtttctctcacttgtacatttttatttaatttagactttgcctctgcttcagtaattgcaggcttaggtatggttctttttctgtgagatgtgaggaagtctcttgctgaaaagccgacaacctcaccgtcatccaaggccactttcatacgaattgcctccgggtacatccggactttattttcaacaggaacatatgaaaatacaccgattttatcatattgggcactttcatcaatttccaaatcatctgtttcaaatccgtttttctttaaaaatgcaagcgctcggttcgatccgtcatttaaactgattttctgatctttcacttccctgttttggatcaagtataccggatgcccgcccttcttcgtaatatccatataaatcactgctttatggtctgggtctttcatgctgatgctatatacatcgcgatttgttttttttccgctctttaccactttaattgaataattgtcatctggggcaaagcgctcagcaatttgttttgcttcctgttcggaaatttgttttcccttcagatggctgaagcctttctcttcttttttcgtactggtgaagctcgggccaagatcagtgccagtggagaatgcaccaacatttttttcgactgttttaaagctgttgataatcgtattatcactttgtttttcgtcagaagccagggccatttctacgtccatccagcgaaggtttttgctcatgacaaggtgctgaacatgacgcaattcattttgtatatcttcggactgctgatatagcttatttagtgatgtatactcgtttttatcaagcggcttttggtccaaatctctgactgacgttttatagctgaaatcgccgatctttgataatagctcttcagttttattaaacggcattaatgtaagcggcagctgactgacactgttatgagcttctgatgtaatcctccacacatcgatcaatgcaggcgacagtgatttttggctgttcatggcaagtgttgttccgattttatcatgaagctgatccatctgataggtaagctcatgaaacgcccgctgatagttattttcagcatgaagaagaactgcgtctttttcctggtgttctttgtatccccagtagcctgtaccgactattgcaataccaagcacggcgattaaaattcctctgatcatttatcacacctctttttatgctttctcatatctgctactcacagaaaatgtgtttaccgattcttttaatctgcggacgcccccaaatccacggacttgtagccgtatccggattaaagtagtaaagtgcttcccctgatgggtcccagccattgatggcatccagcactgcttctcgtgccgtttcattcggctgcatgtaaatttgtccgtcggctactgctgtgaaggcaagcggctcaaaaataacccccgctactgaatttggaaataacgggctgttcaaacggtttaaaatgactgctgcaatagcaacctgcccctcgtacggctcgccccgggcttcgccataaaccgcttgagcaagcagcctgatatcgttgttggaaaatccaccaggcatgttcgctgctaccgcatcctgttttcttgcttttgctggtgtattgttttgctgtttattcgcattcgctttaggctgctgcgttgttttttccgcaggctgtttctgccgtgcttctgcttgttgtcttgccttttgtgttgctgcttttgatggtttcgtctgatactttagcggaatttttccgtaatgcgtgaatgtattccctttattgagctgttccatgacatattcacgatagtattttgatttacatattaaggtttgctttgttttagctcctacaaggccgtcaacctcttttaacccgaattgatcctgaaaatttcgaactgcccagtacgtcccccatccataaaccccgtcaatttttccgttataatatccgttgtattgaagacgcgcctgaagctcgaccacatcatccccggttgcccctctttgaatgacctgattcgaaaaggcagagatcgtttcagtattaataaacgccgttattgtaaaggaaaaaaggatgagacatgccataatcgatcctttggacttcatcttttcaagcctcctactgcaaatttttaagtgtaatcgtattttctgtaacgaggttatttttatacactctttccttgttatccctcagaacataaaaactgcacacaaaaaagccgcacggttgctgtgcggcttctatacttgcatcatattaacggaacgggcttttttcgctttacgcaaaccaaaccaccataaaaataccataaatggaagcatataataaatccaattgctaagcgctgttaggataaaatcatatgatccatgcaaaagggatgggaccactaaagaaagagtaagccactttacacgcgccttatcagcggaaaaacgggcttttccaaggtaaaatcccattataacgccaatcaaggcatggcatgaaacaggcagcagcgccctgacaaacgcatgctccacgccgtggccaattaaataaagaatattttcgagggttgcaaaaccgagtgatacacttgtaccgtacacaatcccgtcataatgctcatcaaagtgggcgtgcgggtaaacactgatcatcagtataaaccattttaatgattcctccaaaaaccccgaagataaaaaagaaacgaaaaagcttccgcctcctacattctctttttcaagtacatactggataaacattatgggaaatacaagaacaaccccgagaaaaaacgaccgtagcaccatatgtacaggttcattatcatactgatcttttaaataaaaataacttaataacgcgatgccgggggcaattcctgcagagatgattgcaaacatcaggcaacctctttcctttatattcctacgtctatcctaccatgttgtttaaaattttacatctgtctgcacttaaaaaaacataaagagcatacgaatgcatcatatgctcctcatctttaatggttttctcttttggcgatttccgctgcgatatgcccccgtgaaacctgccgttttcaataaatatttcatttgcattgtttcccgcagcaataacaccggcaataaagacaccttcaacgttcgtttccatcgtttcttcgttgaaatatggacgccctgtttctttatcaatttcaacaccaattttttcaagaaattgatgatcaggatgatagcctgtcatggcaaatacaaaatcatttttaatggtaatgagttctttctctccggagcgaaacacaacttcatcctcggtgattttttcgacacaagcgccaaattccatacggattgtaccgtttctgacgagagcttcaaattccggcagaatccacggcttaatgcttggagaatactcattgcccctatataaaactgtgacacgcgccccagatttcacgagttcaagggcggcgtccacgcttgaatttttcccgccgatgacaacaacatctttatcaaaatacgggtggccttctttaaaataatgaaatactttcggcaaatcctcaccgggtatattcatatagtttggatgatcataatagcctgtggcgatgatacaatatggcgtcgtgtaggtctcttttgacgtctcaataacgaatgtgtttttttgcgttttcgtcactttatgcaccatttcaaacgcattaacacggatgtttttccgtttaacgacttcccggtaatacgataaagcctggattctgacaggcttcctgttctctgtaataaatgccacatctccgatttcgagcttttcacttgagctgaaaaaggtttgatgcgtcggataattgtaaatactgttaacgacattgcctttttcaatgacgagggcatcaatgccaatttgttttaggtgtatggcagcagatagtccacaaggtcctccgcctataataattgctttttcttgaatcatttctgtcaactcctgcgattggcatttcacttcatattttctatttccgaataaaaaaatctcctattttatcataggagattttttatttttatgcaaatcatcaacttatatccagcctctaaaacgcgaagcttcagccattttgcgaacgccgaccatatatgcagcgagcctcatgtcaattcttcggttgttagccatttcgtaaatattgttaaatgatttgaccatcattttttctaatttttcttctacctcttcttcactccagtagaagccttggttattctgaacccattcaaaataagaaactgttacgccaccggcacttgccagcacgtctggtacaagcagaatgtcccggtctgaaagaatttttgttccttcaagcgttgttggtccattcgctgcttcaacgacaattttagcccggatattatgggcattttcttctgtaatttgattttcaatcgcagcaggaacgagaatatcacaatccagctccagcagctcttggttggtaatggtatcgttgaaaagctttgttacagtaccgaagctgtcgcgtcggtcgagtaaataatcgatatcaaggccttccggatcataaagtccgccatacgcatctgagatgccgacaacttttgcccccgcatcatgcataaattttgccaaatagcttcccgcgtttccgaagccttggacaacgacacgcgcacctttaatatcgatgcctctcttcttagccgcttctttaatacagatggtaacaccttttgctgtcgcagattctctcccgtgagatccgccaagcacaagcggtttgcctgtaataaatccaggcgaattaaattcatcaattcttgaatactcatccatcatccaagccatgatttgtgagtttgtaaatacatccggtgccggcacgtcttttgtcgggccgacaatttggctgattgctctgacataccctctgctcagacgctccagctctctaaacgacatatcccttggatcacaaacaattccgcctttaccaccgccatatggaagatcaattatgccgcattttaaactcatccaaattgaaagcgccttcacctctttttctgttacgttcgggtgaaaacgtatcccgcctttcgttggaccgacagagtcattgtgctgcgcacgatatcctgtgaaaatctttactgaaccgtcgtccatacgaacaggtatttttaccgttaataatctcatcggctcttttaacaattcgtatacctcttcgggatatcccaatttttccagagccttatgtattacggtttgggttgattttaatacatcaagtttgtcctcttctgtatgaccggtgtttcgatcggctgccatttgagttaacctcctagaatcttctgtttctcacatgctccctttcagagaatagtatacaccttcatatgatctgtgcatagaataaacgttatgtttttccatgttttttaacgaaaaaaaactgctgaaatcagcagttttccgttgcattcttatgaaaaatgagtttgtatcgtctctacggcattaccgtccataatgagcttaccatactcttgcaggcgataaatcgttaaagttgtcggattgccgtattcagccagaaccgccacaaccccttcagccgtatgtgaccctagatcttcaaggcttaaaaagtactgcccgtcatagtggtagacagttccccctgtgataccgattcgctgtaagctttctgaaagctgaatgatatcttcaaaggaatggaattgatatatgatgtccgcgctttcatcaagcttgacttgcatttcgatgtaatcatcatcatactcatcgtcttctgaatcggcgtcttggttctttgttacaatcacgaccatcccttgtgcttggagagaatacacttccactgcaatcggtccattcgcttcaaagccgagctctgtatttgcttcattcatcatatctttaaataactggtggactttgaatgagtccttccagaggtcttcttttgtcaatccccggtctgtcaaatcatcgagggttaaaaagattttgatcttattataattcagacgctcaagccgcataacgttccctcctgcctctacttgcacacaaatcatataacacattatatgagatgatgagtcataggttcttaattgttatcagtttacactgagttcactagtaagacaagcacaatgcagtttttattgccatatggatttttgctttttagaagttattctggcccgcaaagagtcacaatgtgtgtttcaggctcagcacctaaacgaagaggcacttttgtcgtgccgtagccgttgctgatcagatatgccgcgtttttaacaatacctgttttccccagttcataaggaccgaattttccaaacctgatctggcctccatgggtatgtccgctgagtatcacatcaataccgtcatcttcattgatttgttcatgaatctccggattatggcaaaccagaatattcagctggctttcatcaagttctttgatggcttcttcataatgatccatctccatcctgatatcatcaacccccgcaatcgcaatcgtatgcccattgtatgaaaacgggactgactcatttctcagagtgatgacgccgtgcgctttaaatatggaatacagcttatgctgcctgacttcataatcattattcccccacacaaacacgatagggaccccgaaatgtacgagccttttgatgttttcctcgattctcgcactgggcaccccgccctcagctaaatcaccgccgattataaccaagtggggggcatggcttcgcgctttttctaaaaggtcttgatcgatgagacgtttgtgaatgtctgaaataaaaaagattgtcagaggcggcttgcccttcatctttgataaaggaaacgtatgtgtcttcaaatgattgccttttgctgttgcatacatttttgccgtcattgccgctgccgcaacagttagtacaccggcaattttcactgatagcttcataaaaaaactctccattctttttagaacttatcaataagacggacaataaaaaaaagacgtttctatcgtttgagaaaacgccccattttatttactttcaaaatatagattaatgtcatatttgtgcttcatcatatgaaaaacagactctctcgccttccatttatcgggctgcggccagagatcagtgcttttctgaataatttcacatctcagtttatggaaatcagtctcggatttttcttcctttttcttgaaataatatgaagtacagtaggcaaaagcggttgccagcatccaaaataaataaaaggtatggctaagtatttcttgaagtataagctgaggctccgggcttttgatcatgatcataacacataataagcctaggcagataagtgaagcccatcgccatctgcggcattgtgctgcataattttcgaatttttgttttcgttttaccagcgcttggagcatctgtttggtcggcgcgtctgtaaactgatccagctgattccataaggattccatacgcttcacaccttgtccattttcattgctacaatatatgaacgtaaaataaaaataataccctattcatccattaaggggatgtccaaaacttgtccggtgtaaacatcatttccattcagatgattatacgctcgaattttttcttctcctgtccggcttttataatacttcatggaaatgcggtatagcgtttctttcttttggacggtgtgcttgacaacgcgattcggcacattttgaactggctcagctggctgttcttgctgttgtactgttgattgggaagaggaagcagccgcggcggttgcttcctccttatttgccgagtcttctttatccgctacagcagtctgtttcttatcagcagctgtttttgccggctcttttggcttggaatcttcaggctcttgttttgactccttctgcagtgcggtttctttagtgtctgcggtatcgtttttatcctctgatttcgggacaacctcatatttgctttggctgctgtcaataaaaacatcttcataatcgtcatgattatccgggtggctctttagataaaataaggtgactaaaacgataaccggcacaaatacaaatattactgcgagtactgtgaataatggcgtttttgttttgccttgcttttttttctgttctctttgattttttacagattgtcttgtcggaaggctttctccatcatcgacataatcgtccgccaatgcggcgttttgatcttcataaagattctgggcttttcttctctctactctcgacatgttcgtcatgtttatccctcctcacatgttcaaaacgaatctgacaggcaaacacggcatcaatgataaaatgcgccgtcatcggaacaaataagttgccggtccattcatacatcagaccgagcaaaaagctgattgctgtcaccataataaataacagccattttgacaaataccgaaagtgcagagcggcaaatataaggctggccgcccataaaccgatatgagtctgcagcactcctctgaataacatttcttccgcgaaagcaatcagaagcgttaaaaatataatatgagggattgacctcttactgaatatttttttattgattccgccgtcatcatataaatgagacggaaaccatttcattactgccatatcggctaaaataacaataacagctatagaaacaccataccagatgattcgcatatcgcgaatgtcccagagctttaatacgtcccgtacatcctcaaaaaagaacagtcctgctgcagcagcggcaaagatgatgagtagctgcgtcaaatataactgcttcagcatatcacggtcagacatatgctgaatataatctttttgctgtttcagttcagctcacctacagtctgcaagctgaatatccggtgcaattccgaactccagctgtctaatggcgccattttactccgttcccctttttgttcatacaaggataaatcaaaaccgcaatgtgaacagcacgggaggtttccgtcatcaggctcgtatgattcatcaaagtaggttaatagtgcctgccttaaacagccatcacgctgaagcaaaaatgatacacggtgcattttttccagcttcagctccatgcgatatgaaatttctttcttcatcagttcaactgatgttttcccctgcataaagagatgaatcatcatacgggcctgtgtctctccgacgccatactgaagtaatacgtcacgaagccttctctcatcccgctcctccgtcttctctagcacacggatcacgtcggcgatttcttcagctgtgacactctccatctggataatctgttcctgcaattcaaaatcccctggcgcccgcagcaaaatgctgacactcggctttccgtcgcggcccgctctgccgatttcctgcataaaagcttctgccgtctgcgggaggtgaaaatgaatcacatatctgatatcgggtttatcgacacccattccaaacgcattcgtacaacatatcacatcaagctggttatgaataaactgctgctgaattaaaatccggtcccctgactccaaaccgccatggtaaaagtcggctctgctgctcgttttgctattaatttcacccgctaattcctcggcccatttccgtgtcggacaataaacaattcccgggccttgcagattttcaaccagctgaatgaccctatctattttttcggcagtatccgccgcattttcaaccctcagtgcgatgtttgggcggttgactgagttgagatggcgtacagcatgctgcagctccagcaggttcatgacatcttgcagcgtttcctttgtagccgtggcggtcaatgccagaacgggcgggtgaccaagtttttttctcagctgcccgagctttgaataatcaggcctgaagtcgtgtccccattcagaaatacaatgcgcttcgtcaataacaaataggctgatcgggacgcttttcaatttttccaatacatatggagactgtaaagcttcaggagacaagtacaaaaatttatatcgatgaatatgttctaaaacaaattgtctttcctgcctgttaagcatgctgttcaaagctgcagcacgcttttccccccgggctttgagctgctgcacctgatcctccattaaagaaagcagtggagaaacgattaataccatgccgtcaagcatataaccaggcagctggtagcaaagcgatttccctcccccagtcgggagcattgcaatggtatccttcccgctgagtatgctttcaataatgtcctgctgcccttttttaaaggaagtaaaaccaaaaaactgatataacgtttgctgtaatttagtcatattgctgcacctgctttgtcaatgccagtctgatttgaaagtagctgaaccgctgttccagcccgtcgcgaatttgtttgattttattcgtccgcatccgtttggcaaactctgcgatttgaagctggtcttctgctgatacatagtcattaatcataaacgcaggctcatggagagaaatctcgacaatgtggtcttcaatcgtcgctgttttcagctttctgatttcagcaattcgctgtatcggaaacccttgtttgaccatctgccatgttttcctcgtcgactctgtcagggcattatctaagtgcacatcagaaaggagatcctttaacaaagcatcttcacactccggaagagaatgaataaaataatgtaccgaagcccaaaacatgatatagacataccattcgtcttctttcagcgtatcagcaagctgcctgctcgtataaccgatccgatggtgcgaggttaaggagtagacaaaaatttgcgctgctttgttttcaatctttttcaaatgcgcctcaagcatggcaaaaaggctttttgccatctctatatgatccgtatgccgggacaggtatttctttacccagtgaagtgtcttatgatcctttgtgacagggatatactgcctgctcccttgctgtttatgggataggacctgcacaagcagcgaaagccttttccaaagcacgccggcagcctgctgataatgagcgccgtgacaatgaacgggccaaggccgctcgctaagggcatgtctcaaaactgctgcgccgctggctgtcactttgtatgtatctgattcagacattggcgcgagatatgaatgcttttcaagcttgtcaagcgacgcagaaatatcgcttctcgaacattttgccgccattccaaagtattttgcagtctgaaataagccggcatcttgaatggtctgtgacgatctcttgcctttgaataggtgaaaaacagcgcttcccgaccgttccccgtttattttgcaaagacaatcgagaaccataatatcgaagtaatttaatgacaacctatccacctacattcttcctgacaaaaatcgttgatttgctctttttattttaacagatttcaaacagaaatcgacgtttaaagtcatcattaagggggatgttatgtagataaccccttatgtgataagcattctcaatcatttttctgttgaaatgtggcagcaacatcattacaataagtaagaggaataggtgttaaattgattaaatataaagattgatccatttgttccaccaagaacaatctgggaggttttattcatggcaaagtacacaatcgtagacaaagatacatgtattgcatgcggcgcttgcggagctgctgcaccagacatttacgattacgatgatgaaggcatcgcgttcgtaacgcttgatgaaaacaaaggtgttgtcgaagttcctgaggtactggaagaagatatgattgacgcatttgaaggatgccctactgattccatcaaagtggcggatgagccatttgaaggcgacccgcttaaatttgaatagaagtaactaaaaaaagctcccgaacgggagctttttttagttaatggatatgtgcacttcgctgctgctcaatccatggcttaagcttgataaaaattagtgagaatacaaccgtaattacaataccttttatcatgttaaacggcaggatacctgcgacgactgctgtttttagcgcgctgtcggataatgccggtgaatgtaaaaaccatgtgtatgccggaagaattagaacataatttaaaatactcattaaaatggtcatcgctgcagttcccaaaagcaggctgacagccaagccctttgctgagttgagttttttaaataagaaagcagtcggtaatataaagagtgttcctgcaataaaattcgcaatttgccctacaggaactccggccatgcttccctgaatgatatactgaagaacattttttatcgcttctacggcaatacccgccaaaggtccgtaaatcagaatggcaataatagcgggaacgtcgctaaaatcgatttttaaataatccggaagacccggaaacgggaaatttaacagcatcaaaacaaatgcaatgctgctcagcatgctgaccacaactaatttttttactttcacttcattctctccttttcgatcacatcttactcgaaaacggaaaggttcttttccagccaataaaaaaaccgcttcatatataaaagcggggtttcgaaaattaggctaggcaaagaaacgtttgaaaaattcaatttcaaaacgcttatgaacctccatcttctcccatccagactgtactgtcggctccggaatctcaccgaatcctgctgtaaagacagctcgcgggcttagagccattggctcatcaccgccggtagggaatttcaccctgccccgaagattgatcatatgaaatttaattacattataaacgataactggttggctgtatagagaattgcttcaaattaaatatattacctgcaagctatcagatcattgatttattaggctttacttttatcctttactgcgtcaatacacgttgacactcttttgagaatatgttaaattatcagatatttagtttgtcaatttaggaggaaatctaacgatgtttcgagtattggtctcagacaaaatgagcaacgacggtttacagccacttattgaatcagactttattgaaatcgttcaaaaaaacgtagcagatgcagaagatgaattacatacttttgatgctcttttggtgcgaagcgcgacaaaagtaacagaagaccttttcaacaaaatgacttctttaaaaattgtcggaagagccggtgtcggtgtcgataatatcgatattgatgaggctacgaaacacggggtaatcgtgatcaatgctccgaacggcaacaccatttcgacagctgagcatacatttgcaatgatctcttctttaatgagacacattccgcaggctaatatctcagtgaaatccagagagtggaaccgcacagcttatgtcggttcagagctttatgggaaaacgcttggtattgtaggattaggccgaatcggaagtgaaattgcacagcgtgcgagagcgttcggtatgactgtgcacgtttttgatcctttcttaacggaagaaagagcgaaaaaaatcggcgtaaacagccgtacatttgaagaagtgcttgaaagtgcggatatcattaccgttcacacgcctttaacaaaagaaacaaaaggcttattgaataaagaaacgattgcaaaaacgaaaaaaggcgttcgcttaattaactgtgcgcgaggcggaattatcgatgaagcagcacttctcgaagctttggaaaacgggcatgttgcgggagcagcgcttgacgttttcgaagtcgaaccgccagttgacaacaaacttgttgatcatccattagtcattgccactcctcacttgggagcatcaacgaaagaagcacagctcaatgtcgctgcccaagtgtcagaagaagttctgcagttcgcaaaaggcctgcctgtcatgtcagctatcaacctgcctgccatgacaaaagatgaatttgctaaaattaagccttaccatcaaattgcaggaaaaattggcagccttgtatcacagtgcatgaaagaaccagtacaggatgttgccattcaatatgaaggcacaattgctaaacttgaaacatcgttcattacaaaagcccttctgtcaggctttttaaaaccgcgcgtagactctactgttaatgaggtcaatgccgggggtgtcgcaaaagaacgcggcatcagcttcagtgaaaaaatttcctcttctgaatctggatacgataactgcatcagcgtaaaagtgacaggagaccgcagcacctttactgtaacggctacgtatattcctcatttcggagaacgaattgtcgagatcaatggatttaatattgatttttatccgacaggtcacttggtgtatatccagcatcaagatacaacaggtgtcatcggccgagtaggacgtattctcggagataatgatattaacattgcaactatgcaggttggccgtaaggaaaaaggcggagaagccatcatgatgctttcctttgacagacatctggaagataaaattgtgaaagaactaacaaatgtccctgatattgtgtctgtgaagctcattgatctgccctaatcaaaaaaactcaagctatctatatagcttgagtttttttatttctatccccgtgtgtttttatgcaaaatatctaagacactccttagctcagaaacaggaatttggcctggtgcggacgcctcttctccagctccaaaagtacaagccgatccaaaaacctcaccgctcagcctgctgatgagccctgttgcagccattgacattgtaataatggggcggtctgcatattttgttttcattgtatacgtcgcatcaagcagtgttaggagatctccagtatcattcggcatgacagccatttttggaatatgcgcgcctaagtcctgcatttttcgaagtctggaaataatttcatcttttacaggtgttttttcaaagtcgtgatttgacatcaccacatagacgttgttttcttccgccagcgatactaacgcctttacatttgcatctcctgaaaataattcgatgtctatcagatcgatgtcttttgtttggattgccgattctagcaaagcaagataggaactttcgtccatctccatgctcccgccctctttgtgggttctgaatgtaaatagaaatagcttgtcttctaaagatttacgaagcttagaaatgagctttgtgaccgcttctctgtcattcgctttttcaaatacgtcgactctccattcaacaatgtccggattcagtaattttactgcctctgcttcattcagaatttgtttttccgtctttcccatcagcggaacgatgattttcggcattccttccccgatggaaactcctttaattgttaacacgttcactcatctcaaatcctttcaatcgttaccttgttttattatacacgtacaacttttttttgaaaatttctattatatgaatagcaactaaaaaagagcctcaaagggcccattttagtttaagaaaatcggatttggagcagccggtaccggaattgcatctgatacgtcatatttgccgattttgtttgttctggtttcggtaaaggtcacttctgtgaagccaaactcttttgcggttaaaagaagtccctcaatcattaaaatactggcaatagaatcctcaacttctgagtcctttgagaaacggatatataagtgcttctgtttcttcgttacagattggacagtacccgcttgaataagcggtgttgtatctttttgactgctcgattccatttccttaatcgcttcttttactgtatcaaaagaatgatttgacggaacgagaaagtcttgtccttgtttattttggtacaagtagtaggatcgttttgactgtttgggaatcgaaatttccgtaaaagtgccatatgagccaatccgaaccccagtctcattttgatccgataaaaatttgactttttcataaggactccattttaaggattctttaagcaatttttttaacagtgtatcatcttttacagaaaatgccgtagctggctgatggactcgtatacttaattccttctgctttggtttttcttttatttctacttcatctatgaaggatggaattgtaatggcatgatccaagatatccaattcactacttacagtcagcatgtcctggatcgtttggtatgcatttgttttttgaatgctgacgggtataattgcagatgtatcggcatcagcaactgctacagtgatgtaattgtcttgttccttttcaggtacaacaaacgatgtatgatccagggatgatgcagcttttgggctgtcttctgtctcagttttcgttactgcgttctcttgggacgcttctttttgttgaggctgtgcctgatcaaagaaatgaggagaaataatgaaggcgatataaaccgcaattgcagcggcacacgcggggccaatccacctgacagcgggcttatttttacgctttgccatcgtcagccgcttgtaaatatcctgaggcgaacgatggtctttaactgccggaagttgacttaacaactcctttatctgttcttcgttccattctgacttcatcatccattagctcctccctcaaaagctccatatgtttccgaagtactttgagccctctgtgttgggtcgtttttactttgctttccgagaagcgcagagccttggctgtttcctgtattgaatatccctgaataaaccgcaagataatcacagctctttgatcgattgtacattgatcaagcgcagcataaatttcccggacattttcatgttgaacggcaagttcgtccggtagcaattgctgatccctgacatcctgtgtatcccagtcaaatgtaccgagtatacgctgtctgattgtttgctgtttacggaaccagtctatcgcaacatggcgtgcgatagacaatagccatgttttttcactgcttcttccttcaaacgtatgataagaatttaatacccggatataaacctcttgaagaaggtcttctgtctggtttttatcctttaccatataaaataaaaattggtacaaatcttgatgatatgtatcatataataattgaaaggtttcttccatttgaaacccctccgttcacttttttgtcgtatgaatagcttgaaaagttacattacaactatattacgagtaactggaatttggaagggaatttatattaacatatccttaaattttattaatgttggctattaaaaaaacacccgctcagtcagcgggtgtttcttatggaacaagattcttcggcaaattcagactcgattttaccgttttgtcggaatataaaaagtaaatgttgttcctttatctattcggctgtgcacagtgattgatccgttgtgggcttccacgatatttttaacgatagccagccctaacccggttcctgctctgccccttgtccgcgctttatctgccttataaaaccgctcaaagataaatggcagatcttcttccggtatgccggacccggagtctttgatatcaattttcaatccatccttcacagaatggactgaaatggagacactgccgccggctgaagtatgccgcagcgcgttatcaatcaaattggtaaatacctgctccatcttgtcttcatcaaacataaattcctcttctgtgagagaaatgtcatgatctaaagcaatatttttttctttcgcaacaccggaaaacttccggatgatcttttctaaaaactcattcacattgattttttcataatgtaagcctgtatggcctgattccattcgggctaaatcaagcaaatcattaactaaacggcccattcggagtgattcgtcataaatgatttgggcaatttctttccggtcttcttcagagcttgcaatgtcatcaacaattgcttcactgtatccctgaagcatggagatcggtgttctcagctcatgactgacatttgcgataaagtcctcccgcagcttatcaaggcggcgttcttctgtcatgtcacgcagtacggcaactgctcctctgacgtgcgattccgcataaagcggcgacatcaaaagcacccatgatctgccttgcagcgtcatctcaatcatttgttctttttcagtgctgacagcgttttgaaacagctcttttgcttcaggcggaaggttgtcgccttctttgatattcatgttctgttcataataccaagcctgaagaaaacgttcagccggcgggttggtcacaagaatcgtaccgtcaatattaatggtaataaccccgtcagccatactgctcaaaatgttagaaagctgctctttttcttgattgagcgcattgatatgaaagttaagctgccggcccatttgattaaaagcggtcgccagttcaccgatttcatcctgagttaaaatcgggatttttgtatcgaacttgcccttcgccaaatcctgcgcgccttctctcatttttcggagagggtacgtgaccctgcttgataaaaagaatgcgaaaaatgtggtcagcacaatcgcaattccagcggcaagaaaaatatagcgggtcgtatgttttgttgtatctttaacggcaagcaaagactgggataaaaagaccatgcctttctttccgtctttttcatacgggacacctacaatcaggcgttcattatccgtgtctgtatcgctcagtcccgtccgtttgcttacttttttatggtctttgagagctttatttaagtctttgtcatgctgtatttgctcaaccgtaatagacgacaggcgatttttatcattcggagaataccagtggttcttctcatcctggatgatggcaatgcttgttaagttatcagcgagttcccaagtgattgaccttgccagtgcctggtcctcgtgattttctaggatgacagcaactttattcgcaagctgtgttaaatcattctcagcttcttccacatggtagttttcaataaactccagcaaaagaaccgttaaaatgaacaatacgatcaagacgagtgaaaggatcgtaaaccacagcttgcctactacgcttttccaaaatttcattcagcgccgacctcaaatttataacctacaccccatactgtgacaatttttttcgcagcttccggagataccttgttcagcttctctctcaagcgtttgacgtgagtgtccactgtccgtaaatcaccaaaaaactcatattgccacacttctttcagaagcttttcccgatcatacaccttgtcaggcgttttcgctaagaaatatagaagctcatactcttttggcgtcaggctcacttctgttccatcagctgttacgcggtgagcatcatggtctattgacagatgtgaaaacacgagcacatttttcgtcggtgtattggcattgaaataagaggtttgggatgctcttctcaaaagggcctttacacgcagcacgacttctctcgggctgaacggcttaacaatataatcatctgttcccgcttcaaacccctgcacccggtttgcttcttctccttttgcggtcagcatgataatgggtgtcgcttttttttcacgaatttgccggcacacttcaattccatcagtccccggcatcatcagatcaagcaaaattaagtcataattggcttcaagccctttggcaatggcttcatcaccattttcagcttcatctatagcataattttcacgttcaagatacattcttaaaaggcggcgaattctggcttcgtcatcaactactaatatttttgtttcgttcgtttggtccatgttttccccctgctttccttctgttactttcattttatcaaatcgtgagaaagtttgagaactgtgtcgctttcaaaggactatgcataagaatgaagtccggcaagcacaagatttacgaatattaaattaaacataataatagcaaaaccgattacggccagccatgctgacttctcaccgtgccagcctcttgacagtcttaagtgcaagtaagcggcatagaacaaaaacgtgatcagcgcccatacttccttagggtcccagccccaaaatctggtccaggcgagctgagcccaaatcattgcaaagatcagcgcgccgagtgtaaagatcggaaatccgattgatacggccctgtacccaacctcatccaccagatcaagattgacgtttttcaccagcggatgtaatagagcgctgattctttttctgatgatcagacggagagccccatacaacacaagacctgctccaaatgaccaaatgacagtgttcacttttctgcctgagaaaagcgcgggaagatcaacaagcggttccattcttccttcggtcaaaagctctccctgatgcggaccgacaagcgcgggcatttcgtacaccatcacgtttttttctttacttttgtccacccagttaaactccgcttcatagcctgcaagacgaaatgctgatgtgattgcaataaaggcgacggttgtgaccaggataaacataatcgcttcaagccagaaggtctttttgcttggctttgtctggtctacatgcttcaaaagaaagatgacaccagcgacaaagctgatggcaagtatagcttgcccaagcgcggccgttgttacgtgaatatacagccagttactttggagcgaaggaattaaaggcgagatatctgtcggaaacatgctggcgtaggcaatcagcaataaagcaattgacagcgtaaacaggcctaatgaaggcaatctatagagaaaataaagaatgataaacgccaaaacaagcatcatgccaaaagcggtggtgaattcaaacatattgctgaccggcgcatggccgctggcagcccaccttgtgatgaaatatccaaggtggcagaaaaaaccgacaatagaaagggtgattccaatgttggcccatcggtttggcctgccctttttatctttattcccgcgtatggccccgccgaagattgggacagcgattaaatacacaagaaaggccgcataaagaaaatttccgctcagctctgccatgacatcactcccttttcgcctatttctgtgttttgattaattctttttggtccaccggttcagtcagtccggaatcagccaatataaatgctaaatccttcttcaggccaaaccagtttttattggtatgccccgctaccataactgcaccgtcctgtgagtgcagccaaattcttcgatgctgccagtacataccttgaataacaccgatcataaaaatggctccgccgacagcaagcacccagagtgtcagatcctttctgactgtaagtccagtaatgtttttcgtttcgacatggtcaaatttcagcttgtatttattattgcctgatccttcgatggtttcttggatggcgacaaagctcttttcgcctttcggtttgtccggcgttatgatattaaagacaaaagccggattgttagggatctttgtttttgtgctcggctctccgtcctgattaaagtagaagtctggcaggtagctggcgatttccaccttgtaaccgttgccaagatcatagaccgaatctggatccagaaggttgatcttcaggctcccaaaggatttttttgtttttttatcaatcagctggaacaccatttggtcaagctgattctctttgtaatccacctggtaaacggaaaaagaatcaaaacgcagcggctgattgacacggatgtcttcttctgttacttttttcagcttcggcttctcgccataaacaattttcccttctctcttgtagagtacggcatcggtttgaaagttctttgccactctaccgtccccgactctgtcaatggcatctgcaaatacctttttttccgttttgctgttataggtctctacgctgaattgattgtttttcaaataatatttcccgtctgtacccggaattgctgcggtttcgccttctctgacccaaagcgtctcatcgacatacatgccaggcacaaatctcagcatcgcaccaaccagaaagatgattaatccaatgtggttgacatacgggccccagcgggaaaagcgtcctttttcagcaagaatgctgccctctttttctctgattctataatgttttttctttaatagagcaactatcttttctttcgattccccgttcagtacagtaaccgtttcactgaacaagcgctgcctttttaaaaaagccgggctccttctgacgccttggttttttaacgctctgtacaacggaatgacccgatcaaggctgcaaatcacgagtgaaatgccgatcgaggcaatgagcagcaaataccaccaagaaccatataaatgatgaaaccctagcaaataataaagctggccgaacgtgccatactgctccttgtaataagtatcagcctgtgcgcccggaggcagataggcttcctggggaaaaatggtgccgaacgctgatgcggcaagggttatgacgataagccatattcccaccttaaccgaggaaaagaaattccaaattttgtcgataatcgttttgttataggtttgcgaacgtcttgcgcttccgtcatatctcatatcagcgagcggaggttgagtttcctgaagagctcttccgcacgattcgcataaaacggttccaaccgggtttatatgtccgcattcacatttgacttgcttcatcccgaagtctctccaggttttatgagattcatatattcgtgtatcatgctttctgtcatagtgccggtcaccaccttgacaacttttccttccggattgatcaaaaaggttgtcggaagcggagatacgtcataggcatcaagcacttggcgatctgtatccagaacaaccgggaaattgactccgtaggatttcataaaattatgtactgctatctttgactccccaacatttacagcgacaatttcaacaccttggcttttaaaatgcttatattggtttgccatataaggaaactcttttttgcacggttcacaccatgtaccccagaaattcaaaaaaacacctttcccttttaagtcactgagctcgatacgtttcccattcgtatcctcaaggacaaaattcggtgcgtcggacccttcggatatactctctttgccggcaaatacagcgttgtaaatggtatagccgagtgcgcagattaaaacgagaaggatgccggtccgaatgaataaacgcctttttttcttcattgtccactgcccccttccccctattgcagatccattcaattatatcattgcacgttcatttcacatttcttactttttgaaggttatgtgaaatttagaaagcgtttttaccgtgatccgccagtgctctgagcctttttacttcgtgaggcgtaagctctctggcatcgcccgtgtgcaggcctcgcaggtttaaaaacgcgtattcctcacgcttcagcttgattacctcatgtccgatcgcttcaaacatgcggcgcacctgtctgttgcgtccctcatggatcgtcagctgaataatgcttgtctgctttttcttatccaaagacagcagcttcgctttagcaggcgctgttttgccttcctccagcctaattccgcgctccaactttctgagcagctctttaggcgggattcctttcaccttcgccacgtatgttttgtctatttcatacttaggatgcattagcttattggcgaattcgccgtcattggttaaaagcaaaagaccgctcgtatcatagtccagacgcccaatcggataaatgcgctgcggaatatttttaaaaaagtccgtcaccactttgcgtcctttatcatcttgcgctgcggaaataacgcctcttggtttatataagagaaagtaaaccggctcttcgcgttcaacctttaacccgtttacctcaatctgatcagaaccggtgaccttaacacctagctctgttactactttgccattcacctttacttttccttctttaatcagctcttctgcctttctgcgcgacgcaactccggcatgagcaatcactttttgcagtctttccatgtctttcacctcaagtattatcttacttttttcaaccttaacaaacaagctttttcaaattcctatgccaaatctaaaaaaaacgccgttttcaggcgctcccaaataataacgtaacgatgatgatagatgcaactacgccgattaaatctgcaagaagtcccacctttaatgcatcacccatttttttaatgccgactgctccgaaatacacagtcagtacgtaaagcgttgtatctgtagatccctgcatgacggaagccagcctgccgataaaggaatcgggcccgtatactgcaattaaatcggtcgtcattccaagtgcggccgtaccggagatcgggcggatcagagcaagcggcactacttcagcagggatgccgatagcggagaaagccggttttaaaagatccattataaaatcaagcgcgcctgatgatctgaaaacagttatagcgacaagcattccgactaaataggggataatggaaaaggcaatttctatcccctctttcccgccttcgacaaacgattcatatgtgggaacctttttgatcgttccataaagaagaattccggcaataatgattggaatcatggctaaagacagccagttgatgatttccatccgctcaccttcccttctttttgcggcggtaataaaaataccgatcaatgataatggcaccgattccggaaataagcgttgccaaaatgcttggcccgacgatatctgtcggcgttttggaggaataagccattcggacagcgatcaccgttgtcgggatgagtgtgatgcaggacgtattaacagctaaaaaagtaatcatcgaccggcttgcttccgatcggtttccgttcagctttttcatttgttccattgctttaatgccaagcggagttgctgcatttccgaggccgaagaaattcgccataagattagataaaatatagcccatcgccgggtgatccggcggtatatcagggaacagtttagatataaaaggtctgcacatccggctgaaaatatccaaaagccctgactgctcggcgattttcattaagccaagccagaaaacaagcacgctcatcaatccaaatgagatcgtaatcgcttctttcgcacccttaaacacggcttcatttacatcttgcagagttccgttgcacatcgcaaaaacgagtccgatcacggttaaactgacccaaattatattgaccattttgctccgcctgccgcattcagaaagattgatttaaacgtttcaaaaaattgtttcttcggtttttgatgccgctcattttcataatagatcggcacttttgcgatggttgcatcgttgaacatgatctccatgtgccctacgatgtcagggattttcgaggcatctttttcccatgcttttttcggcttgagcagtgtggtattaatttttacattttctttttcctcttcggtcagtaaataggtgatatcacgtttgataaaagccttcgattcataaaatgtgcctttcagctttggaatatcccctttttttgcaattaaataggtttgataatgctcaaacacatagttaaacatcttcatatggtcatcccaatcattagggtcattaatggtgacggctatcaggtcaatgccgtcctttgaagccgtagagaccagtgtccgttttgcaagttttgtatagcctgtttttcctcctgtgctgtacggataaagcatggtcagcagtttgtttttgtttttccatacgctttccatcgtttccgctttgtatatttttgtgcctgaaatcttttgatagtctttcagcttcatagcatacttagttaaaatggccatgtcataggctgttgaataatgattttcatggtcgtccaatccgtgcgggttttgaaaacgggtgtttttcataccaagctgctcggctttttgattcatcatataaacaaacccatcgaggctcccaccgacatgctcagcaatcgcgacagcggcatcgtttcctgatcttagcatcaggccatacacaagatctttcagcttcactttttgaccttctgttaaataaatggcggagccttctgttctgacagcatttgccgaaaccgtcactgtttgatccattttgccggattcgatggcgaggacggcggtcataatttttgtgatgctcgcgatccgccttttttgatgctcatccttggcatataacactctgcctgacgcaccgtcaataatgatcgcgctttttgcactgacatctatagcagcatgtgctgtattcacatttacggttgcaataagaaaagaaatcatgatcacgaatactgcttttttgaaaatgcgcatgtttgctcacgtccttgtggtggtttgtacaagtttatgcgcatgtccatcagttatgaataacaattatatttctggaagcaaacataaaaaaactctccctgaaaaagggagagtaaacgttatctgattggcgccatgcttgatccggacgcttcgtaatgagccagctcttccctcatcttcagaaaggccgcgctcaacggcaataataattgctcaagcgacgcaggaacagcatgataaaactcaattgcgctgaccccggtataagacgcccggctattttcacaccacgtgtcttttttcggcataaagaactcttcaatgcattggtgatacacattataaagtgttttttccgctctggcttcctgaaaaggctcctgcatcaggagacgacggcacgcttctgcgcctccttcacaaaatactgccattcttctcagagtgctaagcacatcacagcagtatcctttttcaataggcaattcagcctgtaaggactcaagcgtcgtttgatttaggtaatcgttcacggtattgacaaccattgataagaattcgcctgttttttgagtctgcgctcgcacaatcgaatgtcccatttcgtttggtatcttcccctcatgtctttgtctctcacattttgcttctttcatgatagcttcttccttatatcttatgatgatgaaaaagcgcgattcattaaacttctattttatatcttcgaaggtttggttaaagttttcaaaaaataaatctgcttcttcttgaagaacgtcttcttccgcattttcaggcagcggcggaagctcgtccagcgttttcaggccgaattgttcaagaaaagtcggcgtagtaccgtataaaatggcccgccccggaccatcggcacgccctacttcacacaatagcgccttcgcgacaagactgtgtaaaatccgctctgattttactcctctgatttcttcaatttctgctctcgtaattggctgtttgtatgaaacaatggccagtacttctaaagatgcttgagaaaggccctttgacggcacttcaatcagttttttcaagtaaggcgcaaagtcttttttggtagagagcatgtacgtatctgcatactcaataagttcaatccctcgtgtatctccgcggtattcgtccgccacatccgccatgatcgtgttcagttcaggctcttcgatttcaagcactgttaacagctgcttttttgtaagcccttcatcgcctgccgcataaagaagggcttccacaatagctttccaattcacgatatcaagccccatgaatggattcactccccgtaatgtaaatatctgaaaaattgtgctcctgttcaatgaggaccagctgatttttcatcagctcaagaacagctagaaaggtcactactaaatgttctttttgttcatatggaaacagatccataaagttgattctcgttcctctagatttcaagctgtgcacgatttcgttcattctggcttcgattggtatgtcctgtcttgtaattgttgtttccatcggcctgtttatttttttgcgtttcagcactttttgaaaagctccgatcatatcatagaccgtgacagagagcttttgctcagactgttttacttcttttgcatattcactcaaatcactcggcggtttcgtgaacgatttttgtctttcttcttcccgttcttttaaatccttcgccgcatctttatattttcgatactcaatcagcttttcaatcagttcctcccgcggatcttcttcttcaagtaattcatcttcaaaaagctcctcctcttgcttcgggagcagcattctgcttttaatgctgagcagcgtggcagccataaccaaatactcgctggccatatcgagctcaagcacacgcatcgtatgtacatataataaatattgttcagtgatcttcgccacaggtatatcatatatgtcaatttcaagacgattgattaaatgaagcagcaggtccaatgggccctcaaacgtatcaattttcacttgatattcttccatcatctcaccattttcaagtatcactctcattgccggaaaaactggctaccctatagtataagccaccaaaaagctctcgtccaatactatttcatttcctgttttgaacaagtttgtacagaatattcaaaacacgagaggtgtttgctcggagcgcagaagcgggagaaaaagccttagcttctggttttcctttctaagaagcaatagaggccgagcgttcttttttccttttatcccttctatggtacactaaaagcacattaaaggaggaagcaccttgtatccgaaagcttatatagattatctcgttgagtttcacgcgacacgggattattttgaatgccatgaaatattagaagaatattggaaggaagatccgccaaagaaacgaaaacgctattgggtgggctttattcagcttgcagttgctttatatcatcacagaaggcagaatacagccggggcaaaaagactgatggcgaacagcatccggattcttcaagcagaacaccgggcagtcgaagacttagggcttgatcatggccgtttgctcgaacttatgcaatcggtttacgaacaaatcgaaaccggctctgcctataaaagcattatgctgccaatcaaagatgagaaactggaggaagcatgcaggatcgaatgcaggaaaaaaaagtatacatgggggcagcccagtgcactcaggaacatatttcttatcgacaaacatcgtttgcgggatcggactgacgtcatccgtgaacgtgaaaaagaaatagaacgcagaaaaaaaagcagagactgatcacagcctctgctcagcgtgtcgacaaaccctcgcattcgttgtcaagcctgtgcgttggtgctcacgaatgaaaacattcgctccgctccaatgctcagctttcctagacttcaagggttttcaatcgcgctgaaaggatgacaaaaacctaaaacaaaactgttttcggattttgtcatcaaactaaagcagaggctgatgacagcctctgcttaattattgtatgaaatgtcttgatcctgctgaccttgacaacgttcgaaaaagctctgcgttaattcatttggaaccagtacttgcgttttgaataaatgctttaaagcatccatcatctgttttccgattccttgatggcgatgagaaggattcacactgatatgccggatctcaacctcagaatcctttttttcgactccgattgctccgacgatatcctcgtcctctttccaaagaaagagctggcggtctgtatccgtttcgtagtccttaattgtctgctgaagctgcttaaggtctttttcattcggcataaacgaaagaagccccatcgcaatcttttcaaacgattttttataacgaattaacataaaaacccctctatatccaaaatgtccagtctgctattaacggatacgaataggtgatccgttttctcacattatatcattttcgccatatttttaaactgttttcagcaaattattcaaatgagcggtttaaatttgccatttcaatggcagaaacagcacaatctacacctttgttgcccgcttttgtgccggcacgctcgatagcctgttcgatgttttcagttgttacaattccaaagatgacaggtacaccagtagtgtttgctgcttgcgcgatgccttttgcagcttcattgcagacataatcgtaatgtgtcgtcgcgcctctgatgacagtgcccaatgtgataatagcatcatatttttttgtttccgccatttttttcgcagcaaacggtatttcaaatgcgcctggaacccaagccacatcaatgtcatttgtgtctacaccatgtctgagcagcgcatcttctgctccgctcagcagcttgctcgtaataaaatcattaaatcttcctactacgattccgattttaagacctgtaccaactaaatttccttgtatgatattcatatgattcccatccttttttgtgatatttgtgattagaaatgaagtaaatgacctagcttgttcattttggtttgcaaatattttttattgtgttctttcgcctccatttgaatcggcactctttctgaaatacttagtccgtagccttcaaggcctgcgatttttcgcggattattcgtcaaaagcttcatattccggacaccgaggtcgcgtaaaatttgtgctccgatgccatagttgcgaagatccggcaagaatccaagcgcctcattggcttctacggtgtcataaccttgttcctgaagcttataagcttttaatttattgattaaaccgatgcctcgtccttcttggcgcaagtacagaagcactccacggccttctgcggcaatttggttcagcgcggcgtgcagctgcggtccgcagtcacagcgatgagacccaaacacgtcacctgtgagacattctgagtgcacccggaccaataccggttcttctccgaacggcacctctcccatcacaaatgcgacatgctcttttccatctacctcatttgtgtatccataaaccttaaatgtcccaaaatcagtaggcagcgtaatgtcaacttcacgctcgacaagtgttgtcagattgtaacggtattgaatcaaatccttaatggtgatcatttttaattgatgctttttcgcaatttcaatgagctcaggcactctcgccatcgttccgtcttcattcataatttcacaaatgacgccggctcctggagatccgcaggcttcagcaagatcaacagcagcttctgtatggcccgctcttttcaggacacctccttttttcgcaatcagcggaaaaatgtgccccggacgctgaaaatcagatggcacggatgtgctgtccagcaatgcttgaacggtaaaagatctttcttgagcgctgatacctgtcttcgtttcacgatggtctatacttacggtaaatgcagtgtggtgagaatctgtattatgctccaccatagggtgaagatcaagcctgtctgcgatttcctcactgagcggcgtgcagatcagtcctctcccatgtgtcgccataaagttaatgacttccggcgttgcatgctcggcaagagccacaaagtctccttcattttctctgtcttcatcatctacaacgatgatgacttcgcctttttttaaagcgtccagtgcttcttctatcggatgaaacatgcaaatcttcctctctaaaagccgttttcgcttaagaaggcttttgtaatggtttgttgggtcttattttcattggctttatgcaaaaatcgatacatatattttccgatcatatcgcattcgatattcactttagagccgatcgttttttctgaaaagatcgtttcgctgatcgtatgcggtattaaggagatcgtcactgtgtcttctgtcaggccgaatatggttaagctcacgccatccacagtaattgatccctttaaaaccaatgtttttgttaatgacgggtccatttttaaatcatagtaaactgcgttgcttttctcttcaattcgtgtgatttccgcagttccgtcgacatggcctgagacgaaatggcctccgaaacggccgtttgccgccattgctctttccagatttactttgcttccttttgttaaatcattcagtgacgtagctttgactgtttcaggcataacatccactgtgaattgattttttgtaaaatcagtgaccgtcagacaaatgccgttcactgcaatgctgtcgccaagatgaacatcctctaaaatctttgagcatttaattgttaaggccattgaatgccctgcttttttcatggattcgattgtgcctgtttcttcgataattcctgtaaacatggtcaccatcctattcctttgtcggttttgccgtcagtttgatatcacggccgatttgggttatatcagtaaattgtaataaggggacatctttcattgattgaaaaccttcaccggagattaagctgggagcatgcgttcctccgattagtttaggggcaaaatagaagatgatttcttgaaaacagccttctttgacaaagcttccgtgaacagctgaaccgccttccacatacaccgacatgatgccttcttccgctaggatcttcaaaacatcaggaatttgaatgcgctcggtttcaagtgtaaatatgttcactccgaaagctgaaagccgttttttcttttcctcgtctgcgcgtgccgtcgtaaaaatccatgtcggcgctatttgatcgcaaatcactttagcgtcctcaggaatcgagagtacggtatcaagtatgacccgaaccggctgttttgttacattcggcagtctgcaggttaagcttggattgtcggctttcactgtgccaactccgactaaaatgctttggtgtgttttcctgtattgctgagcatcctgtcttgcagcctctgacgtgatccatttgctgtcacccgtgctggtagctatcttgccgtcaaggctggcagccgcttttagcgtgacgtacggaaggcctgtcctcataaagtgcagaaatttttcattcaggctctccgcctggtctgccaggatgccttcccttacctcaatgccggcttctttcatcatgctgatccctcttccagccacaagcggattaggatctctcatcgccacgaacactcttttgatgccagagttgataatcaattctgcacatggcggtgttttcccgtaatggctgcacggttcgagtgtaacgtaaatgtcggcaccctctgcatgtgctccagccatatggatggcatgaacttctgcatgagcttccccatattttaaatgggcgcccattccgacaatttgtccgtcctttacgacaacagcgccgacgagcggattggattcggtctgtccttcgccctgcttcgcaagatctaaggccagcttcatataatactcttccatttgtttccctcccctcttttgttatttaccgtcaaaaaagccccgaatttataaaaaattcggggctttaggtattttacgcaataggaaataacactatgcatttttgaaccatttgcatagcggttcatcatccttctcccatccagactttcactgtcggcttcagcttaaactgaatccaccgcgtgcttatgcacacgggtcacgggctctaaagcaaatgtgctttactaccgccggtcgggatttccaccctgccccgaaggatacaatctttattcatttgtccttattggctattatagcgatcctttttaaagtacgcaatgaaataaacttacaatttgagaaaaacaaaacatcacccttcgatccgaaaggtgatgttttgttaatcattcacttttgcaaccttgattaatccgtcgatccgctttgatttgctgaagtatgccttaatcttgtcaccttcttttatatcagataaatcctgatttaatttttttccgttgaagatgattttcgttccgttttctgctactccatgatactctgagccgtcaattttcgtcactttatattcctggatggtgtattcctcttcttccgaggacaaggtttgtccaattgctgtcggaacatccttcagctcaacgtcatttatgtacatataaccgcctgcaagtaaaagcaaaagcactaacagaatggtaatcttggtttttattcttcccatttctaaacctccagccaatatgaatctattcattcatatgagttattcctttttttcatgaataaaaaaccgtaaattctcgtaaattattaatataacgatgcataacgggaatatgtttcacatttctgcaaaaatttcttttctatagatatacgaatttatgttctgttttaaggggatgaccgcaaaaaagatataaaaaagcagcctctcgggaagctgcttgatcctaatttgttttgcgcatttcgttaaacgggtagaaaacaaactttgacgtacccgcaatttgttttttcgtgaagaggccaaggccgttacggctgtccatggaattgcgacgattgtcacccatcacaaaatacttgttatcaggcactttaaccgggccgaaatcatcggtcaaatggtcaaaaccgtcctgtttcgctctctttttattagccgccaaataaggttcgtccacctttttcccgttgatatagagctggtcatttttcatctcaaccgtatcgccgggaaggccgataatacgtttgacatagtgaacatcatctccgtttaacacgacgatgtctcctctatcaaactcgccgatgtatttgactgtcatattaacaaaaaccctttcacggttgtgaagtgtaggatacatagagtcaccatcaacgacatacggcgcaaaaataaagttgcggatgagcaaagcaagaacgacagcaatcacaattgcttttgcccattctaatattgactttttcttcgaaacattttctgatttcaactgatttcctccaataaacaacggtcttcaatttatgttatcacgaatcgaaaaaaaatcccattaggaccattgaagtgattttacaaactgttaatcttcatcttctacccacatcatgcctattttttcttgtcgatcataactaggcctgaaaatattgaaagaaatgaatcgcataattcagaagcgatggactcagaagaaagagagttctcatatgcaaaatctttagatcgtatataaagcatgaggttacgggcagtttgttcatttactgcattccattgatctcccagtccatgatacccatggcacttgacaaaacaattaacgtcatgaaggttactggaatgtttgcggcaacctatttcacaggtgataaccgcaccccgttttttgctttcataatatgtttaaaatcattcaagctcgaaaacatggatcagcctccaaaaaataaatccaatatattcccggcagttgaagactctttattataaaactctgaatatccgcagttcttacagtaaaccactagaaatcggttatgctgcacgtcaaacagctttgataatcccgtgccggttgtggctatttctttttgtccggcttcagtactgccgcattttatacagcctttgttgtccataccgcgatctccttttcattacatcacgtttgtttgatttattttactacaaaataccaatcccaatgaaccgtactactttaaagtttgcttaattttgatcccccgttctttacatactaattgggttcgtttctcagcttggtaaatcttctggagaaacggaaaagctccatgaccaaaacatttaaacccagccaaacaccgccgaaggcgcaacccgcagcaacatcactcggatactgctcattaacgcgtacacacgatcagcccgatgaggaataaaacgataatcatcaaaaaacgcaacagtttgcagacgagccttgtgagaatgacgaacaaaaagataagcacaaaaaccaaaaatgacaaatgccgttaacgtctgttcgctcgggaatggatataatacatgactttccaaaggagcgtgaacaggatgaagggaatgaaagagccgtctaattccctctccataaagctctcgcaccaacgactaggaaaaataagaaagagagttcgattttccggtcttgccctttgaatactgtccaaagaaaagttagaacaataactgctaacagaacatctctagacgcaaaagctttctgaattgcagctgggcccagtctatacccgatccaatacgacatgctcactcccgcacagctccccaatccggccgctaacatgcttagcacccagtttaacttttcttgaaacacgagaacaccggcaaactctcctggtccaagtaaagatagaaactctaacatcaagacaataaacaagacggcatatccgtactgttcgagcaaccccgtcaaaacttgcatgtcattctccttaaacttttttgttcttttatcattcccaatccactttttgtataatcagcacaatttcaccttcagtcgtccaacaacattgtctatggcgggatcttctctcctatactcgtcactcatacattcttttttgacataggaggagcaatagcatgaaatgggaggaaacaaaagatacacagggagtttgccaaaattttgggcagttcgttctgccaccgagtcaggtgtttgtttgcctacctcattccttggccattccccattttccccgtttgaggttcgcaatgataaagtatttcacttagtttcgtacatgaagaggtaaattctttgctcaccgaactatgatagctgcgcatgatgattactgcattgcataaccactggttatttagtgagccgtgagcaatgtatatgcactttgagtcagcacaggatgatcctattacattcgccagaaaagcagctgccgcattcagagtagttaaaagaatagacagatagctgggcttccggaaggaggcgcttttttcgagcatttttataaatcaataaaaataggcatcttctaaatatttttgccgataagtttacgctaatcaactctagcactaatacatataaacaatagaatgatatgaaaggagacttaatagtatgattgattatcctattaatataaacaacgtttccgggaacagtgtaattaacgtaggcggcgcttttatgatcaggcctttaactttgtccaaatctgtgtttggctccggaggtttaaatacaggaattgtctttgaaaataactttgtaagcaaggctaaaatgattaatcatcaatttactgatcaaaacgtcaccaaaactttttaatctattcattacgggggcttgcgatgtctcactaactaaacacctggttttgccaaccgccatcagcactcggcggttttttattgaacatttttacccaataaaaaagctccctctatatgaggaagccttttgcctgccaattagccttctacgcgaacttctttcatgacatcgccgttagacatgtttttcgcgaattctaatccgcttgttactttaccgaatacagtgtgaacaccgttcaaatgaggctgtggctcatgaacgatgaaaaattggctgccgccagtgtcttttccggcatgtgccatagaaagtgcgcccgcctcatgtgtatgcgggtttccttctgtttcacatttgattgtgtatcccggaccgccagtaccagttccgtgcgggcagccgccttggctgacgaagccaggaatcactcggtggaatgtaagcccgtcataaaagccttcgttcgcaagcttttcaaagtttgcaacagttccaggtgcagcttcaggataaagttcaaattcgattttgttcccgtcttctaataaaaagtaacctgttttcaattgtatgcctactttctttattttaattttcaaaggagattatgtatgataggttatagcctgtctctccttgtcgcggctattataccacacctttcgggggaaaacgaatctcccgggctttactaaaaaataaaaatgaaacctgaatctctttatctccgtctaacctaacggaactgtatttttcatgattcaggtcctcacaaagcagcactatccagctgcttgtgaaattgaaggaggtcaaactgctttgaagaaaatttggattggaatgctggcagcggccgttttgctgctgacggttccgaaggtcagtctcgcggatgccgcagttggagatgtcattgtaacactgggtgctgatttgtcagaatccgacaaacaaaaagtgcttgatgaaatgaatgtccctgataatgccacaacggtaaccgtgaccaataaggaagaacatgaatatttaggaaaatatatatcgaacgcgcaaatcggatcgagagcgatttcttcatcgtcaatcaccattgccaaaaaaggctccggattgaatgttgagacccataatatcagcggcatcacagatgaaatgtacctgaatgcactgatgacagccggtgttaaagatgcgaaggtgtatgttacagcaccgtttgaagtatccgggactgcggctttaactggattgattaaggcgtatgaagtttcttcagacgaagcgatctcggaggatgttaaacaagtcgccaaccaagagcttgtcacgacatcagagcttggagacaaaatcggtaacgaaaatgcatcagccctgattgcaaaaatcaaagaagagtttgctaaaaacggggtgcctgataataaagctgacatcgaaaaacaagtggacgacgcagcttctgatttaaatgtcacgcttacagacagccaaaagaatcagcttgtctccctattcaataagatgaaaaatgctgacattgactggggacaggtcagtgaccagcttgataaagcgaaagataagattacgaaattcatagaatcagatgaaggcaaaaacttcatccagaaagtcattgatttcttcgtatctatctggaatgcgattgtatctatattcaaataggaaaagcgccgaaaaatcggcgctttcttttattgctttacacccgttttaaatggcagatcaagttttacaatatcttcgtatgtttctcgcttcacgactaaatgagcctcaccgttttcgacaaatacaacggcgggtctcggaatacggttataattgttggccatgctgtatccataagcgcctgtacaaaaaacggcaagaagatcgccttcttttacttccggcaggtcaatatcccaaatcagcatatctccgctttcacagcactttccggcaattgataccgttttgtcatgcgcttctccgatcctgttggctgccgcagcttcatatttagcttggtaaagcgcaggacgaatattgtcgttcatgcctccgtctacagccacatattggcggacacccggcacttctttttgagagccaatcgtataaagagttgtgcctgcgtctcctacgagagaacggcccggttcgatccaaatttccgggatgtcaaaaccgtaacgggaagcattttctttcacagcttcgataattttttcaacgtattcagtggcatgaagcggttcatcatcttccgtataacgaatgccgaaacctcctccaagattcagcaccttggatacaaatgaatatgaatctctccattcgtctagttttttgaagattttttccgctgctaacacaaaaccggccgtatcaaagatttgcgagccgatatggcaatggacacccagcagctgaatgtgttccgattgtaatacttgttcaatggcccgttcagtttgtccgttatgaagatcgaaaccaaactttgaatcttcctggcccgttgtaatgtagtcatgcgtatgcgcttctactccgggcgtgatccgaagaagaacatcgatggagtgacccgtttctttacataggtcttcaagaagcgcaatttcatagaaattatccaccacaatgcagccgatgcggtgctcaagcgccatgcgcagttcttccctgctcttattgtttccatgaaagtggatgcgttctgccggaaagcctgccgcaacagccgtatatagctctcctccggatacgacatctaaagaaagtccctcttcctcagcgagctgaatcattgcgactgatgagaatgctttgctcgcatatgccacctgtgctttcagccctgcagaaataaacgcctgtttaaagcttttagcacgctcacgtattaaagccacatcatatacgtaaagaggtgtaccatatttctccgctaaatagagagcatccacacctccgatttctaaatgaccatgttgattttgtctgcttgtgccgtgtaagaacaatgtcattccctctttctccgcttatggatgaaaggacagttttatggactgtcccttcataattaagacatacattatcatactcttcagtcagtttcaatgcgattatgaattggtaggctgtcttaagcgatttttggggtgaacgatactgggtcttacttttgcgccaggtttcgctgtgcggacaagaacctgccacagcgcctttccgttaaagggaatcagcggccataagtacggtgtctgaagggatttgatgcttgtcatggcaataattagcactgtaaatccgatgacgagcccttttatatgaaataaagcaacgagtatcatgaggacaagacggctcattttgtttgccaagcttaattcataactaggcgtcgtaaaggttccaatcgccgcaagtgagacgtacagaatcacctcaggagaaaaaaggccgacctcaatcgcaatctgcccgatcagaacagcggcaattaaacccattgctgtcgataaagccgtcggtgtgtgaatggcagccattctgagaaactcgattcctaagtcagctaaaaatatctgcaggatgatcgggatatgcgtatctttatttaaaccgataaatttcatgttgtccgggagcagatcaggctgaagcacaaagagaaaccagatcggaagaaataaagtagaagcaagaataccgaaaaatcttacccatcttaaaaaggtcccgactgaaggcgcctgcctatattcttcagcatgctgcacatggtgaaataaagtcgtcggggtaatgatcacactcggcgatgtgtccactataatgataacatggccttctagaacatgatttgcggccacatccggtctttctgtatagcgcacgagcggaaaaggattatagctttgattaacaatgaattcctcgacagttttgtctgccattgttaatccatcgacatcaatggatgcaatttctttttctacgatctcaaccagatccggatcagctatatcttctatataacaaatgcttaaatccgtctttgaccgctcaccaactttcgtcatcttgactcgaaggcgttcgtctctgatccgccttctgagaagggccgtattgacgacgatattttcaacaaatccgtctctggctcccctgactaccttttccgtatcaggttcttccgggtttctgcccggatagcttctgacgtcaattataaatgcgaaacctgcaccttcaacaatgacagcgacgagcccggacagcacttggtcggtggtttcatccaatgtttttactttttcgacctgggcgttcagcagcctgttttcgacgatgtcgaccagctcatcagggtcttctttccgattgttaatggcaacaagttctctcattaaatgaataatataggctgtatcgcataatccatttagatagtaaagctggatctctttatctaaaatcgtgagcttgcgaacacctacatcatagctcgtccccatcccgacacggtttttgaaatactcttcatttttagctggattccgataaacccgaattttctcttccttgtggtccggcatgatacccgctcctttctaaaataaactcgaccgctttcatggtgattggcgacccttttgagatatcgtcttttctgcccattttgccgatatccccgataccaacaataagcgggagatcaagtttatcaaggcaatagactgtatctccactcattctgtggtcatcaaattccctttccccgactttatcgacgccgtattcagttatttctccattgcggtcaatgcttacatcgaccctggtccattcagcctgatgtgtttttgacgcgaccgcaatcacaccgagcacttcaatagacggatgggttgcgacataggtcagagcggcttctcccggaccctctccttgaaggccggagtcgtcaaacatgacaaatacaggatcatacggtgctgaggcgatcagcttgacaagctcggcgccgctgcgggtggaaggattcccttttgattgtgaaatacatcgacctcccactttgcttgcggcgtattcaattgttttagcggcataaacatccccgtctgttaccagtatgaccttgcgttttgtcgtcatgtcggcattatcctttcggtttgaaaataacagctacgataaaggcgaaaagaatagcggctgagataccggccgaggtcagctcaaaaatccccatgccgattcctataaatccgtgtatatgcgcctgatgcatagcaccgtgcagaagactgtgaccgaagctgacgatcggaacggtggcgcctcctccggcaaattcaataaatttatcgtaaatgccgaaaccatctaatattgcaccgattacaacaaatgatgtcatgacatgagctggcgtcaatttaaaaatatccaagagcagctggccgacgatacaaatggccccgccgcatacaaaagccaaaaggtagtccatgttaagatgcacctcctgcacgctcaaatacaaccccgtgggcgatagtcgggatggtttctttttgctggatcatcgtcgggcttaacagcgccccggtcgccacgacaaatacacggtttaattttccttctctcagctgcttaaaaatatgagagtaggtgacaaccgctgaacaagcacagccactcccccggcaaagacctgctgatccggagtgtaaatcagaagcccgcaatcatcatgctttgtgccgactggatatccatcttcttttaagatgtcttttacgattggagaaccgacgcctgacaggtcacctgtcaggattagatcatagtcatccgctgtccggttgagatctttaaagtgctgcttaatcgtatcagctgcagccggagccatagccgatcccatatcaaaaggatctgtaatccctaaatcagaaacctttccgacagtcgcacttgtgatttggatatcacccggtgtctgactgatgacaactgcaccgcttccggttacagtggaggtagcagtgtccggtttttggcctccgtattctgtcggatagcgaaactgtctttccgcagttgcattgtgactgctggtggcagcaagtgcccttttggcaaacccgccatcaactaaggctgatgcgacagccactgtttccattgatgttgaacaggcgccaaacatacaaagaaatgggattttcaagtgtcttgccacatagttagccgtcacgttttggttcagcaagtcgcctgccagcaataggtcaatatcatcttttgtcagattgtttttttgaagcgcaacattaacagcgtcttccatcagctggcgttccgccatttcccagcttttttgattacaatgcatttcgtcataggttttatcaaataacgagccgagcggtccgtctttttcctttggtcctgctgccgttcccgctgagttgacaaatatgggatgttcaaatacccaggtttgctttcctgttaatttcattttcttctcctcctatgacatcagtttctcaaaagcaaaccgaatcattccaacgatgtatgcagctacaactccgaaaacaataacatttcctgccagtttaaacatatttgtcgctactccaagcactaatccttcacttttatattcaagagccgcgcttgccatactgttggcaaaacctgtgacaggtacggctgaacctgcgcctgcgaattgtccgattctgtcatagatgccgaaccctgtaagcagggcggaaattaatatcagcgttgcagctgttggattccccgcagttttttcattgaaatcaaaaaaatgaatataaaaattttgcagaccttgcccgattgcacaaatcagtccgcccactaaaaaggcttttacacagttccagacgtaaggcggcttaggctgatatgttttcacttttgatttgtaattttcttttatgtttgtcatcttgaaacctccttatgaatggtcaataaagtacagccaatgaaataaggatcccgcgattttcccaatcacgatggccattaacagaataatgattttacttctgagcccgattcgttttgccaaaatcggcaggacatttaaaacctctgtaagagcagccgctagcatcccgacgaacaaacctgccagaagcccgaccggcacagctatccattttgttagataaagatgattcatatgaagcgtctcccatcccccgcaaaccgcgccaagaataacagccgcttcataagcctgaacaaatctcattgttttggtgagctgcatcagccgcggaatgattcccattacggttaaaaaagcaacgaaacccgcccccaccgttatgcctccgccgagcccgacaaaaataatgaacaatacactaacgatcatgcagatcctttatggtttcttgattctcatgcatggccacatattgatcgagatcaagctgatagttaaacatctcaacctccagcgggctgggctcttcatttaggcgctttttaaatatgtggttaaaaaacacgatcatccccagtcccaaaccgatgctgtatgggatttgaagcaaatatggatagtcattcctctctccggttatgatttcatatagtgcgatatgaacatctctcatgcttacatcctcatgaaagttcatgatggcaagacacgatccaataaacagaagcagccagacaccgataaatagaaccgttgataaatttcgctttcgatattgaatttcaacaatggtttctgctccgcctacggtttgaacatcaagtgtcggatcttgtaaatgaatggctctgaggacttgtatgatatccagaattacgatatttttatctttttcgctcacctgataaagcggcatagccgaaagtttctttttcagctgaagctgcccttctatttgcgcggcatctccaacggtaataatatcccctggatgtgccagcacccggtggcgaagccggataaatattcgtcgttccatcattgatcaccatctttcggtggttatatatgtagtatgtggttcgattttgttctcattcatccgctcgaaaagaccataaattaccacgcttttgcacataaaaaagctagcctgcactgcagactagccatccgtatgatccatttgaaccttgatctgttttaatattttcttttcaagcctggaaacctgcacctgagagatcccgagccgctcagccacctcggactgtgtctggtctttataatatctgagatagacgattagtttttccctttcctccaaatcgctgattgcttctttcagcgcaattttgtcaaaccatttttcttctgagttgtcagcgatttgatcaagcagggtaatcggatctccgtcattttcataaacggtttcgtgaatcgaagatggagcccttaccgcctcttgggccagtacaacatcctcagcttcaatctccaaatggtcagcgatctcctgcaccgtcggcactctgcccagtgttttcgaaagctcatccttcgcgcgccggattttgtttccaagctcttttaatgatcgtgatacctttacagttccgtcatcacggataaatcgctggatttctccgataatcatcggcactgcatacgttgaaaaacgcacatcataggttaaatcaaatttgtcaacagattttaacagcccgatgcagccgatctggaagagatcgtcaggctcatatcctctgtttaaaaaccgctgtacgacagaccaaacaagacgcatgtttttttctatgaggaggtctcttgcctgctggtcgccattttggctttgtttgattaattcctttacttcatgatccttcagctgagcgtttttgccgtttttcttaacctccacatccataacaaatctccttaattacaaagcgctttgctttttgataagtgctttgttaagcgaatcgttgttcccatttcaggcgatgaatcgatactgacatcatccatgaaattttccataatggtaaagcccattccagagcgctcaagctcaggcttagtcgtaaatagaggctgacgggcttcttcaagatctgtaatgcctaagccttcatcacgaatagtcatatatacgacatgatcttccagcgtcactgaaatgtaaactttcccttcacagttctcttcatatccatggataattgcatttgtgactgcctctgacacgactgttttgatttcagtcagttcatccattgtcgggtccagctgagctataaatgaagcaactgtcacacgggcgaacgattcattctgactgagggcagaaaactcaaggtgcatttcatttttcatgatgccacccccagtgtcaggagcgcctgctgttcagattgttcaaatcggataattttaaacagacccgacatatcaaacaatcgcttcaccgcaggagagatagcgcaaacaaccatttctccgccaatttgcttaatttgcttgtatcttcctaaaataacgccaagccccgagctgtccataaaggaaaggtcctccaagttcagcacgatatggcgaatatcatccttctccaatgattgagtcactttttgcttcagggtttcagccgtatggtgatcgagttcgcctgttaatcgaatacaaagcacagattctttgacattcatgtcaattccaaggctcatgctcattcctccttgatatgatcggataatgagtgtttcgatttcgacggaatgaattccttcaccgtgacaaaactagtggtcattcggcataattacttaaattttgtccagtctcccatcgtccgctttaagaatgtgataaacccggctttcttcatatcttcttttgcagcaacaggactttcagcgagtacttctccatcctttttcagaacaagagtgccaagctcttggcctttttgaatcggagcactaatattgtccttcatcttgatttcttttttcacatcgttcatatcctcgccttttttcgtcaatattgaaatcggctcagatgtagtgagttcgatcaatttttgtttcccttttttgacctttacttttgctactgtttgatttcgtttatataaaggatgcgtttcatattgactaaaggcgaagtcaagcatttttgtcacttgcgcgtttctttctttaggcgtgctcgctccgaatacaaccgctatggcccgcatgtttccttttttagccgaagcagtcagacaatatttcgcttcgcctgtatagcctgtttttacgccgtctacaccaggataaaatttgataaggcgatttgtatttacaagccaaaactttttatctgtattttcacgcagataatcttcatacgtgccggtaaacttcgtaattgattcgtatttcaataattccttagccatgattgccatgtcataagcagagctgtagtgtccttcctcggtcagtcctgttgggtttttaaaggatgtatttttcaatcccagctcttttgcttttttgttcattttcttcacaaattcttcttcagagccggaaataaattcagccatggcgacggaagcgtcatttcccgaagcgattgcgatgcctttcagcatttctttgacagtcatttcttcgccgggctcaaggaatatctgtgagccgcccattgacgccgcatgctcgcttgtacggactttatcactcattttgattttgcctttatctaaagcttccataatcaaaagcatcgtcataattttcgtcatgcttgcaggcgccagtctctcattgctgttcttgttgtaaagcacttttcctgtgtcacgttctatcagcaccgcagacttcgcttcatgagcaagctccgatgtacgttttccgtcttgttttgcaaatgcagacggtgcaaatgtaagcagcattataccaatcaacaaagtggataaaagacgtttcatctcaaaagccctccatttcataatcctttttattttttccaagcgggatggttttatacgccactgatggaaaatgtttcgaattttgggcgtaaaaaaagacagctgtgtgatatcagacacagctgtcttttggtcctgcattgattcatttttattcgtactgagcgacgatcgctttaacaagctttaagaatccagcttttactttttcggtcacttccataacttcatcgtgacttaaaggctgatccagaattccggctgccgcgttagagatgcaggaaatgccaagaacccgcattcccgcatgattcgctacaatgacttccggaacagtagacatgccgactgcatcagagcccatcgttcttaagaaccggacttctgccggtgtttcgtaagaaggtcctgtcacagcagtgtacacgcctttttgaattgggatattaaggtctttcgcaatcttttcagccaggctggacagatctttgtcataggctgaagacatatctggaaatctggcgccgaaatctgcttcgtttggcccgattaacgggtttgttcccataaagttgatatgatcggtaataatcattaagtctcccgcacggaattcagtgttgacaccgcctgcggcatttgtcacgatcaacgcttccacaccgagcgctttcatcacgcgtacagggaatgtgactttctccattgagtagccttcataaaaatgaaagcggccctgcattgcaatgacggaaactccttcaagagtgccaagcacaagctgtccggcatgcccttcaacagtagataccgggaattcaggtatatcttcatatttcagcttgaccggattttcaatttcgtccgccaaaatgccaagacctgagcctaaaataaggccgatcttcggagattccggcaggttttgtttaataaaagcggctgcgcgttcaattctgtccttcaagaaacagtccccctattgtaataaagataaaaagcttttcccgtatttcggtttattcgtttggaaattatcagcgatcgttgcaccgatatcagcaaatgtatctgcaagcggcagcatttgcgctttcttatgttttttgctgtaagcgagaatcggcacatactcgcgtgtatggtcagtcccatgatgaatcggatcattgccgtggtcggctgtaataattaacagatcgtcttctctcattttttcaaacacttccggaagccgcgcatcaaattcttcaagcgcgcgtccgtagccttcagggtcacggcggtgtccgaataacgcgtcaaaatcaacaaggttcgcaaagctcagacccgtaaagtcttctcccagcgtatcgatcaccttgtccattccgtccatattagaaaccgttctgcgtgaagaagtaatgccttctccgtcgtaaatatcagagatttttccgattgaaatcacatctaagccgctgtctttcaattcattcatgacagtgcgatcaaacggcttcagcgcataatcatggcggtttggcgtccgtttgaattgacccggctctccgacgaacggccgtgcaataatgcggccaaccatatatttcggatcaagcgtcagttctctcgccgtttcgcaaatgcgatacagctcctcaagcggcacaacctcttcgtgagcggcaatttgcagaacagagtcagcagacgtgtaaacaattaaagcccctgtctccatgtgctcctggccaagctcatccaaaatcgctgtgccggaagccggcttgtttccaataattttgcggccagatctcttttccagctcttgaagcaattcatcaggaaagccttccgggaacactttaaacggtttatcaatgtataaacccataatctcccaatggccggtcatcgtatctttgccgtttgacgcttcttgcatttttccataataggcaagcggatgttctgttttttctacacctttgatatcttcgataagaccaaggccgagctttgccatattcggcatatgtaatccgttcatatgctcggcaatatgaccgagcgtatgagcgccttcgtcattaaagtcagcggcatccggcgcttcgccgattccgactgagtccatcacaattaaaaacacacgattatatttgtatgcaggcatcttgaaagcctcctttttttctatacgtctattgtatcgctaagaggtctgacaactcaagtataaaccgttttcattcccgttgacaatgtatttggaaataatgagaaacttcaatattttctgtcgctctaaacaaaaaagccgcagccacctgcggctatgctcgcggatgaaactgcttgtacacatccttcagccttgttttcgtcacatgcgtataaatttgcgtcgtggatatatccgcatgcccgagcatttcctgcaccgctcttaaatctgccccgttctcaagcagatgcgtcgcaaaggaatgcctgagcgtatgcggagtcagctctttcttaatgccggcttccaacgcgatttttttcaggttcttccaaaatccctggcggctgatctgtttgccgtgatgatttaaaaagagggcgtcagacacattgttctttaacagttttcccctggcttttgtcatatattcctcaatggcggaagcggcggcttcaccaattggcacaatccgttcttttcttcctttgccaaagcatcggataaaccccatagataaatgaacatctgccgttttcaactcaatcatttcactgactcgtatgcctgtcgcataaagcagctccagcattgctttatcccgatagccgaatgggctcgtcagcttaggcgtgtccaataaccgctcgacttcattgagtgcgagcaccttcggaagcgcccgttccgtcttttgtgtttcgatatgaacggaagggtccttatccgttactttttccctgagcagaaattgatgaaaagagcgaatggatgccaaatgccgcgccgatgtcttaccggatttccccgagtccttcaaatactttaagtattggataatatgtatgcgggtaacgtggttccaatccgtcacatgaagggtttctgttaagtagagagaatagcttttcaagtcacgttcataggatacgatcgtattttgagagagccctctctctaccatgacgtagtggatgaaatcctttatttgatctttcactcttgatctactccccgttttggtaaaaaaagatcaaccggtcgagccatccgcctttttcatcctgatccatttcaacaacttttacagcggagccttccggtttatcataccgatgatagttttcatactcttgattcacccatatcatagcataatagaacaaagcggtaaaaccggtaaacaggatgaaaactttcaatgcatcgacagctgttttcaggaatcttcccatgtcctaatcgatcctttcctatggttccagttatataaaccatatgccaaatcagaaaggttttatacatagaaacagcaaaaaaccctttccccatgagaaaaggttcgcgctcggcaccatctattcagtttcttttccattacagcggtggcaaatgccgtgaaacgtcaatctatgatctttaatcttaaatttccaatcacgttcaatgatttcttccacgtcttcaagcaaatcttcttcaatttcatcaacggctccgcactccatgcacaccaagtggtgatgaaagtgagctgcgccctctttccgaaggtcgtaacgggacacgccgtctccaaagttaattttatctacgacttttaattcagttaataattcaagcgtacggtatactgtagcgagaccgatctcaggagatttctcttttacgaggaggtatacatcttctgcgcttaaatggtcttcttcgttttcaagcagcactcttactgtcgcttcacgctgtggcgtaagtttatagctggatgagtgcagttgtttcttaattcgatcaatacggttttccatgtctttccctcctacgccgcattccatgactcattataacaaaatacgcgcagagttccaactataattattataaactgataaataaaacggttttcttttaataataattttaaaaaagtctagatgtaagcttttccattaaaacaggagataagtatgcttcaaacagagatgagatcagcgctaaaaacagaatgaccagcagcacaaaggcataccgcccgaaccattgaatcggcgcgtcatgcaggcttcgtttcacgaacagctgtctgattaactttaaagaaaacgcaattgcacatgtgcccataatgagataagccggaatcagcagcacattttgcggcaaaacggcgacaaatgataggaaaaacccgcttactcccatctgattgactaggaacccgacagtaaagccgacgacgatccctttcagaaagatcataatgaaaataatcggcatcccaatgacggaaattccgagtatccacatcaggcctaaatactttgcattatgaaagatactttgcccaaacatatcagctgaacttgcctgttttccatccgaaagctgtccaaaaaattgacttaagtagtagtataaatcttctttctggctgatggtcatactgttgacaataatcgcgccaaagatgacacccatgaaaaacagcactgacacaaatatataaagagagagatgatctttgacatgcctgagaaacatgtccttataagagatttttcgcataccgtttcctcccgcccgttctagtgatttgatttaatagattgtatgaaagaaacggaaaaacatgccctttttcaaaaagaaacgatagagatgaatgctaggcggctttttggggcacaaaaaaatccttatcatcaactgctgtatgatcataaggattcttatgcttccgtttattcaaaatctcttttttgctttttgtcattctttcatgtgtgctgaaagatggtgtgctgcctcttgataataagacgtcacgtccgccgtttctcaatcgatgcccccgcttctttttcgcttggctttttgccatgtgatcactcccttttttattttcatagtaatgataacaaaattgaacaatgataagaaaaaaacagcacctgctacgacaggtgctgtttagctacatttatttcactgctgtaagagctgcatgctcgacagctgctgctaccgcatgatggacttttgaatcaagcggctgagggacaacatcaccttgtttagtgcaagctgcgatggcctctgctgctgcgacaagcatatcatgattaatctccgtgctttttgcgttaagcgctcctctaaaaatccccggaaaaccgagtacattattaacagaacgcccgtcagctgcatatgcggcgccagcctgcagcgcggcctccggttcaatttccggcttcggattcgataaagccaaaatcacttgaccagaacgtacaaatgccggttttattaaacccggaacgcccgttgtagcaatgacaatatcacatgtttccatgagctcctcaatactggaaactgcctgtccgccgtattgttcgagacgattcattgctgactctgatttgtctgttccgtacacagcattcacaccataagccatgaacatccggcagatggccacgcctgctgcgccaaggccgatttgccccactttcgcttccttcaggtcaacccccgcactcctgcatgccgaaatggcagctgccagcgtcactacagctgtaccatgctggtcatcgtgcataacagggatgttcagctcctcttttaggcgatcctcgatttcaaaacaatgcggcgaaccgatatcctcaagaaggatgccgctaaagcccggagaaatatgttttactgttttgatgatttcttcaggatcactcgtatcaagcagtatcggaatgccgctaatacccgccagctgatcaaacaaagcagcctttccttccatgacaggcatgccagccacagagccgatattcccaaggcctaaaattgcggttccatccgttacaattgcaacagaattgctgatcgttgtataaatagaagctttttcaggttctttttcgatcagtcggcacacgtccgcaacacctggtgtgtagacacgtcccagctctgccagtgaacggatcggcattttgcttttcatttggatttttccgccttcatgtgcggacaggacttcatcagatacggtgtgaagcctgatcccttctccgagggcctgtacagccgcgatcacttcctgaagctgttcttcattctccacttgaacggtaatattccgcattgtgtaattgggtccgacttttaccgtctccacttcaccaatatccccgcccagaaggccgatggccgtagccacccttccaagatttccgggaaccgaaggcgtttcgatcatcagtgtccgaatcatgtgtttcgctatcattcagtgatcctcccctattagcctagtttttcggctttaactgtattgtttttcgtataccatataaattttcctgtataaccatagataattgcaagacctattgctacaaaactgagccacataaacggcagataagagaaggtagaaacacctaaaataccagccatgtaaatcccattatcagaccaaggaaccatccccgaagtcaatgttcccccgacctctgagttacgtgataacactcttctgtccagatgtaagcgatcatagctgtcttccataattttcggagtcaaaataagagatacatacatcgcacagccgaagatgtttgctaaaaacgctacgatcagtgtagacaatgtgacattgccggctgaagttaatttcttttcaaacgttgaaacaatgacttttaacacgccgagtttctcaagcagaccgccaaaaccaaggccaaagatgatgacgacgagagaatcaagcataccgacaattccaccgcggtttaacaagccgttcaaaaattcaacatccgttttaatagagaagccgttgtacgcagttgcaatcgcatgggcaatatccattccttggaaaacaacagcccagattgcaccgagtaaagcgccaattacgataaccggcatagatggctttttcatcgccaataagactatgacgagaactgccgggatcagcatccaaatatgaatgtcaaacgtgttttgcaaagatgattttaagaattcaactttatcaagatcaatatttttcccgccgtacataaatccaacaactgtaaagagtatagctgtaatgacataagcaggtattgataaataaagcattgctctcacgtgagccaatacatcgacttttgatagtgaagaagctagaactgtactgtcagacagcggagacagcttgtccccaaaataagcacctgaaagaatagctcccgctactagaggaagcggaatgcctaacccctctccaattgcgatcatggcaatgccggcagttccgactgttccccatgacgttcctgttgccacagacataatggaacaaataattaacgttgccagtaaaaagatacttgggtgaataaattccagtccgtaataaatcaaagtcggcacaacgcctccggcaatccatgttccgatgagcgccccaactgaaacgagaatcagtacggcttcaaggccatttgatatcccatgtacaatcgcattttgtaaatctttataagaataaccgagtctaatacctaaaagcattgcaataaaccatgaaacaaaaagcgccagctgtatcggcaagtcgagaaagactgtaaacgatagaacaagtgctaaaaatactcctagtacaataataatttcaaatagtgttggcaatcttacatccttcaaaagaagtcccccttcatgtaaaagctaaaacgctttcaatatatagtgcaacacgtatactatacttcctcatccctatgttgtaaacagcttattcatccgactattcggagatgaataagctgtattttatacaaattttatttttctaatagttctttccctgcgatacctggtttggtcatctcatatgggtttaaaataatatccaattcttcttctgtcagcacatcatgctgcaggcaaaggtcacggactgattggcctgtcataatcgcttccctggcaattctggcagccgcttcatatccaagatgcggattgacagctgtgatcacgcctgcgcttttttctacgtattgcttcaaccgcttttcgttggcttcaatgccttttaagcagttgtcagtgaacgaacggaagccgttgttcatgatgctgatggattgaagcaaattaaagacaagcacgggctccatgacgttcaactcaagctggccggcttctgaagcaaggcagattgtattgtcgtttccgataacctggaacgcaatttggttgatcagctccgccataactggattgactttccccggcataatagatgaacccggctgacgtgcaggcagagaaatttccgcaagtccggcgcgcggtcccgacgccattaagcgcaggtcgtttgcgatcttcgacatgttcatcatgcagacttttaatgaagctgatacctctgtataggcatctgtattttgtgttgcatcaacaagatggtcagcgccgacaagaggaagcccgctaatatcagcaaggtgctttactacctgtttgatatattcaggatcagcgttcagccctgtaccaacagcagttgcgcccatgttgacttcatacaggtgctggcgcgattgcttgattcgtttgatatcacgctcgagaacacggctgtaagcttcgaattcctggccaagacggatcggaaccgcatcttgaaggtgtgtccggcccattttaataacagagtcaaactcctgtgctttttgcttaaacacactatgcatatcttccattgttttcagcagtttttccaagagcttcaatgtggaaatatgaatagcagtcgggaacacatcgttcgtagactgtgacatgttcacatgtgtgtttggacttaaatggatataatctccctttttatggcccatgatttcaagcgcccggtttccgataacctcattcgcgttcatgttcatagaagttccggcaccgccctgaatcggatcgacgataaactgatcgtgccacttgccttccagaatctcgtcagcggcttgtacgatagcttggccaattccttcatacagccgtttcacgtccatgttggcaagagccgcagcttttttcacaatcgccagtgcgttaatcatttcctcatggattttgtatcctgtgatcgggaaattttcagaagcacggagcgtctgaattccgtaataaacatctgcctcaatttgtttttctccaaggaagtctttttccacgcgatattctttttggccgtttaacataatctttaaccttctttctctttgctggttatcgtttttacattttacaggacaacgtcatcagcaatcggtgtttccataattctcttgacgacaggaagatccgaagactgacctagtgcccacatcaattttggcacaattgcttctgtgttcatatttcttgatcggataattaagtcttggttgaccctgcggccaacttcgtaaatgctcatgtcttcgccttcttcaagacattgagtcgtaatgacgacgacaatgccgctttcgatcagttcattcacttttgacaaaatgtctctgccttcaaacggcacccctccgctgccataactctcaatgacaatccctttgtacatgcttttcagggcatcaaacatttcaggctttaagcctggatgcagcttcagcagacatacatctgtgcatagtgaagtgtcaactgtgaaggtgtcgttctcaggttccgttacttgtttgttgtattcgatcccgtcttcattgataaaagcgatatatgggtaattgatgctttcaaatgcgtcgtagcttttcgttcttaatttgatcgcacgcgttccctgaatgactctgccgtcaaacacaacataaacgccgcccacgccttcacaggcaaatcgaatggcatctgtaatattttttttggcatcggttttttggaacgtgatcggaatctgcgagccggtgatgacaatcggctttttggcatgctgcagcatatacgatagtgcggcagatgtataggccattgtatctgtaccgtgagtaataacaaacccgtcataggcatcataattttccttaacggcttctgctatttccacccagtattcaggctgcatattggtgctgtctatattcataagcgactgagtttccattgtgtaatcgttatcaagttttgatacgtaacttaataattcatcagccttgactccgggagccagcccattttccccttcaactgaagcaatcgttcccccagttgtcaacatcaataattttttcataccatgcacctcttcactgtatctaaagatgggttgcgagaaggtattcgcttttcgcatacttttaatgcaattatagacacggaaaataaaatacgcaagacattattattcaattcgcgtacacttcctaatacctatatgatataatcagctcaaggtgaaaaaggagcggaagttcatgaatctagatcgtttaactgaattgagaaaaaagaaaaattggtcgcttcaatatacagctgaccttctcggtatcgcaaaaagcacatatgccggctacgagtcaggctaccgacggccttcacttgaagcgcttgccatgctggctgacctctttgacacaacctgcgatgaacttttaggccgcgagaaacaaaagcagactgctcctcaggccatagaattggccacgtggagcagccttgactttaccatttctgttgatggccagccgctgagtgaagatgaaatcatccagctgattacctttatacgcacaaaaagaaaagtacaggaggaactgagttaatctttagctcacggtttaattttaccgtaggttcctcctcctccggctttcaattccagttttccggatctcgcttttacgataagcgccgcagttttcggcgggacaatgcgagccaaatcttcttctgcagcctcatgaagaacagccatttctgttccgaaggctttttttagtttgtccagcgttttcgggcctacacccggaacaaattgcagcgggatctgatgtacatatcgcggacgcgggacgcgaacttcaagctgatcactcaattcacgcaatctttcgctgactcccttggtaaatctggcatttccgcaattcgcgcacgctgtttccccgcttacagcaggctctccgcacgcttcgcaagcggtctgataatatttccccaataacgggtccaagccataatttgcgataattttcctgtcatcttgtccctttaatgcaagagcaaattcagtaaaatcagctgactgcacatatagttcattatattctctgccgattttccccaacgaatgcgcatcagaatttgttaaaaaaggatacggattcaattcagatacctgtgatgccatgtctgtatcacagcttaatccaagctccaccgcgtctatcatagatggatcaaaaacctcagttaagcttgatttaaccccttttccatataagcttttatgcggcgtaaagatatgggcggggataaacaagccgcccatatcctgcacttttttttgcaggtttaagcccgtttcataaatccgctgcgagcttaaatgaatatttttcagccgggctgacagccagtttgaaaactgtttcatatcagccagcgtcggcataaatacgagcacatggatcggtccgctacaggcttcatcataaatctccagctcgctccccaataaaagagtcgtgctgcgataacggattcctcccccgtcaagctcgcgatattttccagatgaaatgccttcctcaagctctagaatgacttccggagaatgacagtcgataatgccgaggagttcaattcctttatgttcactggcttcaaccaaaattctgtccagtgttaatgttttagcgcctgttattttgacagcccttcctgtaaaggtccggccgatatgaatgtgcaaatccgcgtaaatctttttcatttttgtgcttggagcgcttctttcagctgaagatactgaatcgcgtaggctgttttagcatcgtatacttcacgcgattcaaccagctttagcgcatcttcaagcgtcacctccatcacttcaacaaactcgtcctcatcaagctcccgtttttcttcaagcacagaaagctcctcagcaagaaaaacgtgaacgatttcatctgcaaatccgggtgatgtataaaacgcagttatttttgtcagtttttttgctgtataaccggtttcctcttcaagttcccgaagtgccgtatactccggctcctcacctttttcaagcttaccggccggaatttcaacgatcgtccgctcaagcggcttacggaattgtttgaccaggatgattttcccttcatctgtgacggctagtaccgctactgctccagggtgtttcacaatttcacgtttactggctttgccgtttggcagctctacatcctcgacataaagatcaatgactttacccgaaaagatctgttctttggcaattgttttttcttctaatgatttcatttcttcatctcccgttctgtctctatatgatgccccatacattttatcatactagagcaaaagggggcttcttcgtgaaagtgcaccgcatgccaaaaggtgttgtcttagtcggaaaagcatgggaaattcgggcgaagttaaaagagtatggacgcacatttcaatatgttaaagattggatctcaaagccataaaagttgaaactttagctcctttatattacggtcaatacaaagcctaaaaaaggagtgtgcacatgagaaagcgcaaattgggtacatctgatttagacattagtgaagtcggactcggctgtatgtctcttggaactgaaaaaaacaaagcattgtccattctggatgaagcgatcgagctcggcatcaactatttggacacagcggatttgtatgaccggggacgcaacgaagaaatggtcggtgatgcgatccaaaacagacgccaggatattattctggcaacaaaagcgggaaaccgttgggatgacggaagcgagggctggtattgggacccttcaaaagcttacataaaagaggcggtaaaaaagagccttacacgtctgaaaacagattatatcgacctttatcagcttcacggcggcacgatagaggacaacattgatgaaacgatcgaagcgtttgaggaattaaaacaagaaggtgtcatccgctactacggcatttcttccatccgcccgaatgtgattaaagaatatgtaaaaaaatcaaacatcgtcagcattatgatgcaattcagcctgtttgacagacgccctgaggaatggctcccgcttttagaggaacatcaaatcagcgtagtcgccagaggtcctgttgccaaagggctcttaactgaaaaaccgcttgatcaagcttcagacagtatgaaacaaaacgggtacttgtcctattcattcgaggaactgacaaatgcccgcaaggcaatggaggaagtggctcccgatctttccatgacagaaaagtcgctgcagtatctgctagcacagccggctgtcgcttcagtgattacaggcgccagtaagattgagcagttacgggaaaatattcaggcagcaaatgcacggcgtttaaccgaggaggaaatcaaagcgctccaatctcatacgaaacaagacatttacaaagctcatcgctcatagcagaaaaaccagcacccgtacaggtgctggtttatttatattgatgccaatccatttggctttcatttaggagttcttcaaagctcttatttttttcgatctcttttttctttctgatctgttctgctttttctctttcctgcctcttttcatcctcttccttcaattggctcttcatctccataagctttgctttgatatcggattgaaggccgtcttttagctggtgtttgtcagcaagatttttgttttttcattcagacttcccccatgttttgttttgaagacagtttatcacggagcatatacactgaacaagccgactctcttctgatcactttctcagcggagcagtgtttaggtataatgatttcaaacacgaattgcctatatatttagttgaaaggtgctgtgacttttgaagaaaatccttttggccattggcgctctcgtaacagctgtcatcgcaatcggaattgttttttcaaatatgattctattcatcaagaaaaaaacggatgaagacattatcaaaagagagacagacaacggacatgatgtgtttgaatcatttgagcaaatggagaaaaccgcttttgtgataccctccgcttacgggtacgacataaaaggataccatgtcgcaccgcatgacacaccaaataccatcatcatctgccacggggtgacgatgaatgtactgaattctcttaagtatatgcatttatttcttggtctcggctggaatgtgctcatttatgaccatcgccggcatggccaaagcggcggaaagacgaccagctacgggttttacgaaaaggatgatctcaataaggttgtcagctggctcaaaaacaaaacaaatcatcgcggattgatcggaattcatggtgagtcgatgggggctgtgaccgccctgctttatgctggtgcacactgcagcgatggcgctgatttttatattgccgattgtccgttcacatgttttgatgaacagcttgcctaccggctgagagcggaatacaggctcccgtcttggcccctgcttcctatcgccgacttctttttgaagctgaggggaggctatcgcgcacgtgaagtatctccgcttgctgtcattgataaaattgaaaagccggtcctctttattcacagtaaggatgatgactacattcctgtttcttcaaccgagcggctttatgaaaagaaacgcgggccgaaagcgctgtacattgccgagaacggtgaacacgccatgtcatataccaaaaatcgggatacgtaccgaaaaacagtgcaggagtttttagacaacatgaatgattcaacagaataaaaaagcgaaaggcctattcggctcttccgcttttttatgttacagaacgtcggtaatgccatccatattttctctgatccattcaatcgcaagatctatcgttgtaaactcctgcgtctcaaaggtcatttcatcctgcaatagccagacatctttcttgatggactctgctcctccgattgaccagtgaagcaaggtatagggatggttttgattcaggaaggatacccacgttttattttgtgctgtgttcttcattgccttcagcttttgttccacgtttcgcgtctcctactttactaatatgctcattctggggctgagcatttcagccgggcttttcagcgccaatgttttggctttttcattgtaatcgatcgtcatttgatcgtcaaaaaacactttttgtgacgattggatatacagcggaatgccgttcgtttccagctgctcgcactgtcccgttaattcttctgccagccagattgtggggacaccgcttaccgcgcagccgcatccttctgcatcgtaacgaagctgggctttttttcccgggttggcgtcaaacgcctgctgcagtgcctgttttgctgcatctgtcacatgtatgttcataaggtgaaacccccgttttcatcattttcgctattgtagcatacaacactgccattcgcattgtttctgccttttttccaccgcttcgcattttcttctgcagtcttgatccactcatctttcccttttatgtactgattgatgctgtcaggatgctgggccgccagccgttttttgagaacggcgtattctttcgctatgtttggatgagctctgagataatctctgaataacagatgcctttcaatagcagggtttccctgttcgtacatatggacatgatgagtgcgtttatttccgcccttttggaaataacgcctgcccgctatgccgttctcaccttttggtgtatagccgttagccttcatttgttcatcaaattggctcacggcttcaatgcttctgacttcaattaacatatcaatgattggcttcgctgccatgttcggtatcgatgtgcttccgatgtgatgaacagcgataatctccggcccgaacacaagtttcagcagttctttttcttcatcgaaacattctgcccatttttcgttgtagagaatgacctcaacttttcttttcggatacaaatgaaagaccgacagcaatagaccctgcgctgctttgacggtttctgccttttggaatccggcctgtgtatagagtgacacggccggggtattgttctcggctgtgactacttcgattttctcagcgtcttcattatgatcaatgacaaattgcagaagtgctcgtccaattccttttctgaaaccgtcaggatgcacaacaagcctgcaaatggtgagatgatgcatgtttttctcatatgaaatgacaccgatcagcttgccgtttttccgatatcccgcaaaccgttcatgggatgcttgaatatccttcaccttctcttgtaaagcgggaataccgtcaaaaccgataatctctgtttcctttatgtaggcggggatctgtacggctaaaatctcacgcgctatcgtgtcttccttatgctggagaaattcaatcattcgtgttcctcctgaaacagccgctgtctttcgacttttgcgacgcggactgcatacgactcgtaccaaaggctttttcctttttcttttgccgcttgatgttcagtgtgatgcttccaatggttaattgcgtccatactgtcccaataggaaactgtgatgccccttccatccgcttcacgtacgctttccacgcctaaaaatccaggctgatccgccgcaagtgataccatccgctccgctgtttctccatatcctgtgtcattttcgcttttgacagaagaaaaaatgactgcatagtaaggaggctcaggtgtttttgataaaaaatccatcatatttccccctcatatgtttttgacaaacagtaccctgtcttgacccggaccatcatagtttgcaaacactgagatgccatttaccgtcttggtgcccttttcaatatcaaaccccaattttgtgtgatatgcgattgataccttattcacaggtgaggtgacgcactttacccgggtgcagcctctttgttttactgtttcgataaatacatcatacaattgtttacctatttgcatttttctgaaatctggatgcacaccggaaaaatgaatgtacgccgtttcaggatccgattgcgattgaaatccgattaaaaatcccgtcatgctgttatgttcggatgtaataaagcttgtgtcctgaaaatgctcaaaaaatagtctcggcaatttttctttcagctgtctgccgccccaccattcattcagtacagacgttaccatttcataatctgaagacgtgattgttcgaatatccattacgatttgatctccctccgtctggcaaaacgaatgtcagctctttttctcacaatataaaaattatattttgcctggctggaattgtaaatgccttctttcctgtatcatacgtttccagactgccgagggaacaatgtttgatcattttacgcctatttctcccccaaacaggaggagagactttacagcacaatatcaagcacttgatcaagtttcagcttataaagctgatcctcgtctccttttatccatactgctttttcaaactcttcataccggcagattttcccggtgcagcagacaatctcaccgtcctgaaagcagctgacagtgatatcctgagcaaactccatcgcggtgcaaagcgtttgattcatctcttccagcttatcggggtcaaggatcggcttttgcagcttctgtttaagtcgctttctctccagcaggctttgcttatgttccggcagaaacatcctgctcccttcccacagcaggttgcccctttttaaatgatcgttcatttataatgcccccctattttagccgcacgttcaaatgcctggcctgccgctgtcagtgacgccgccctgatgattgctgtgtcgccgaatcgatttttaatgccgtccatcacatagcctaggctcattttctttgcataatcctgaaataaattgagctgccatatgtcatcagatgagagctgagacagattgacaccgagacggcggacaggtttcccgtcccaaaatgtaagaaacagccggcgtacagcctcatatacatcctgcgtagaattagtcggctctgccagcttcacttgccggttgaagcccgtcggccaatcaaaatcagcaccccggcagctcactgacaccgtctgccccatgaccccggcgtttcggcttcgcctgcacacttcttcactcagctcaagcaatacgaccttgatttctttgtcaaagtgttcgtagtctctcgggagagtcattccatggcctatcgccttttgcccgtccagagacgaagttgacacaggggaatagtcgattccgtttgccgtcatccacagcacgtggccgttaatgccccatttcttttttaaaagatcgagcggaaaagccgcgagcccgccgatcgtgctgatgcccattcgatttaaatgatgcttcatgcggctcccgacgccaaacatgctgcccaccgggagcggccacatttcggttttcatattttctttcgttaaggtaaaaataccgttcgtattctttttggcaaaattgtcacacgcaattttggccagcgctttgttagggccgattccgacccgtgcataaacgccgatctcccgcatgattctgccctgaatgcttttcgcgatctccatcggcgtcccaaacagcttctggctgcctgtaatgtccatgaactgttcatcgatagaataaggctccacaaggtctgtatactcctcgagaatggccgtaatttgcagtgatacatcaatataccgctgcatacgcggccggagcacaacagcctcaggacacttttcctgcgcctcccacagccgtgaagcattcaccacacccttttgtttcgccagcgggcaggcagccaatacgactccgccccttttttcagggtcacccgaaacaatgacgggcttatttttcaaatatggattttccgctttctctacagatgcataaaacgattgcatgtcaacgagaaaaatcactttttctttcatcatacacacctctaaaaagaacttatgttcgtttttcattatatgcgaaagtatgttcgttttatactggtaaatgattcttgtctgacagaaaatatgatccaagggtttgagagaagaaaaacatttagtagaataaaagcgaacataaggataggagagtcatgatggagaaatttgtcgaaaaaatgatggaacaggcattgcgtcaatacggcagaaacgttgctatagatccgttaagcccgtatgaaaaacaaagcctgaaagcggctctacaagagagacggaatgaagaaccagatgaggatttgcatgcgcatatagaagatatcatttatgactatgtcacaaaccaaggtctgttctcttaaacgcatgactgtcagttctttcagccgctgatgcggcttccctttgaaaacaccgcctgaaacaaataaacagtctcaggcttacagaaaaaagcaggattttctcacgctccatagattcatatggcctggcgtaaaattccccctcagaactcgcgcaaaacggaataagctgtccatgatcacgcgtatacactttttcgaagagatgtgctctcttgttctgtcatgcggtccatcggttttcagcttacatcttgatctcatagccggtttcactgccgatatgatctacgtcctggcggcttaaactaacacaccctcactgaccaatcgctttgcttttcatcggacatcccgtcatttttcttcttcaatttcaagatgtaaactccgtcagccacacgcatcctcaacgcatagtatattgccatccatacaatcaggcatactacatgtcaaaaacgaaatattttgaatgatctattggagaaggaaattttttcatatatgatagaggaagatcttacatacaggagagaatataattcatgaagaaatggaaagatatccacccgatcagctggacaattataatcggaaccattttcggcagaatggcaacatcgatgagcattccttttttagcgatttatttgacagccgtccaaggcgcatcagcttcctatgcagggctggtcatcgccgcgagctcatcagtcggcatcctcgcaagcttttacggcggatatatctcagataaattcggcagaaaaaacatgatgcttgtatcgattttcggatggatgctggtatttgcaggctttgcggcggcatctcatctctgggtgttttttgtagttaacgcattaaacggtctttgcaaatcactgtttgagcccgcttcaaaggccttgctgtctgatatgacagaagaaaaaacgagactgctagtttttaatttacgctatgcagctattaatatcggcgttgtcttcggacctgtgcttggcctatatttcggctcatcgcaatcgactacgccctttttggtgcctgcagtcatttacggactatacggaattgtgcttgccctccaatttaaaaaacatccatccttatcagcaccagcccagtcccgaaatatgagcgtgcgggaagcgtttatggtcacgcaaaaggattatctttttaccattgctttggtcggcattacgctatgcaccttcggctactcacaattcagttccacattccctcagtatatggcgcagaaccccttgatcggcaatggaacgaagctgtatgggctgatgctgacattaaacgcaatcgttgtgttggcgacgcaatttcccattgtccattttgcaaaacggttttcgccgctttgttctctgatgctcggtaatgtgatggttagcatcagcatggccattttcaccgtatcgcacggtgttccatcaattgtgatgattgtcatcacatttacaatcggcgaagtgcttttattctctatgatggatttgtatgtagaccagattgcaaaaacagggttaaaaggcacttatttcggggcaatcggtttttcacagctcggaaacgtcatcggcccttgggtcggggggatatgtatagacctgtttggcgctggccgtccgatttatattttttctgtcctgagcggcattaccctgctcggcctgccatttttagcgttcgcctatcggcagatgaaaacggagactacaaaacaccgttcccgtctggaaaagccgctttaaataaaaaaacgggagagaatcaatctctcccgcaacaatgaggtgatgaacatgaatataggcgatatgatgtttcagctgtttgtatttattatatttgccgctgttatctttgcggctgttacaggcttcaagtatgcgaaaaaccgaaaagcgcagctggatcgcattgagaaaaagctgaacagcctgtccgaagatcacgattaacagcttggggcaacgagctctaccttaatccgatccggatcctcacaatagactgcataatgcccgtctcctccggcaaaaggatgcctgtctcggtacaacacacgatagccttttgccgtcaatttttcggtcatctgatcgacttgatgcttggattcagcataaaatgcgagatggttcagaccgactcggcatctatggtattccggctctagaaatggctctttcgcctgcacaatcactaggtaaaaacgatctttcttccagctgatgcctgagctccatttttgatactctttatagccaagttcttttaagaaccagccccaaaaccgcctagacgcctccaaatcagagacatacagttcgatatgatgcacaatttcataccctccttaccagcacttcctcgaccttatgcccgtctcccttacgcaaaatgagatctgacctgaatttagtcggcaaaatattttcatataaattcggccggttgacactctcccaaatcgaggctgccatctcgtcagcctcctgatcggacaagtctttaaatttatgaaaatatgaatcaggattttgaaaagcagtttcccgaagcaggcgaaaacgctctaaataccaagtgaaaatccggctttcctccgcatccacataaatcgaaaaatcaaagaaatcggaaacaaaaatacgcgggttttcccggtcatcctccaaggtgggcgactgaagcacattaatgccttcaataatcacaatatccgcctgttctacaacctcgaacacaccttcctcgcggtcataggttagatgggaatacaccggggcctttacgctgtcctttcctgattttaagtcattcaaaaattcgagcagcgcctttacatcatagctttcaggaaacccttttctagacatcatatttttctttttcagctcggcagtaggaaataaaaaaccatctgtcgtgataaggctcacttttggacggtcaggcaaacgcgaaagcagcttctgcaagatccgcgccgtcgtgctttttccgactgcgacactgccggcaatgccgataataaacggaattttggctgaatgtggatgcttcaaaaaaacattgacatgcttattgcgttcagccgcagacttgacatgtaaatgaagcaagcgaacaagcggaatatagatcgtttccacttcttcaacagatagataatcattcaatccttccacagcttttgcctcttcttcagatacagcaatcgacaaatgccccccaaaaccagaccaagactcccgattgtgctgtgtatataaagtatgtaggttaagttctttatttttcactgtttacacctgactctctgtaggttaaaacccttacaaagattgtaacggaaaaccttttcactgtctgcttatttttcatttcgtttttttagcaaatcagcaccaattcggttatacgcagccatttcatcttttggaaccatgcttcctcccgttccccagacgacatgtacagcatgttccatcttatatttttgaccatagcgccttccctcttctgtcgaaaaaagctgaaccggcccgaacatgcccgcaagagcagagggctctaaatatttatcttcagatacagccagcatatgaagcaaagtataaagcgtattgtcctctaccgtataacagccgctcagaagcggttcaatcagcttgccgacaaatcctgacggcctccctacggcaagtccgtcagcagcagtctgattatccaggccgatatcctggacggagatcttttcgtgaagtcctgaataaagccctaacagcatacaaggtgaatgagttggttctgcgaaaaacacatgaacatcatctccgtataaaagcttcagcccaaatgctacaccgcccggtcctccgccgactccgcacggcagatacacaaacaagggcgtctcaagacttggctttatattcatacagtcaagctgcgtttttaatcggcttgcagcaacagcatatcctaagaacagctgtcgagaatgttcatcatcaataaaataacagaatggatcatgttccgcctgccgtctcccttcgttcaccgcttcgctgtaatctgtttcgtactccataacagtgactcccttttgacggaggagatcctttttccactgcttagcatcggcggacatatgcactgtcacgcgaaagccgagtgccgcgccgatgatgccgatgcttaaacctagatttcctgtcgaaccgacagcaatcgaatagcgggagaaaaacccggtaaaccgctcttcctgtaagatgcggtaatcatcggtttcctgaagcattccttcttgaagcgcgagattttcagcatgctttaacacttcataaatcccgcccctcgctttaatcgatcctgaaatcggaagctcatggtcgcactttaaaagccatcttccgggaaatggctgctgatatgccgcttccagctttcccttcatatgctgcacctcaaaaagcggagactcgatgattcctttagcgcctttcgtctcaggaaacacctcggcaatgtaaggtgcaaaccgctgcattcttttttccgcttccgctatctcggttgcccactcatctgcacggggtaatggcccctctttcttgcctgaatttgcccagaatacaggctctgcatcaatcagtttctgaataaacggatctttaagcagagcatgaaggacttctgaatgaactgacattcaacaatctctcccttccactatcaaaaactgccccgtgagaaacaagccactccaccacaggcagttctatcattattttttcatgagcgcgcgtcctgccagcttttctacaagagctggaaacagctgatacagcttagtgccggcattcattaaacgcggaagattgatctcccgctttttcgtaaaaattgcagctgtaatttgagctgccacgtcatcaggatcaagcatccagcggccgacatttttggcgtagtccccgcctttatcagcaatggaaaaaaagtccgtctgaatcgggcccgggttgactgttgtcacataaatgccggttcccgaaagctccatccgcaaagcgtttgagtaacctaacacggcatgtttggtcgcggaatacaggctagacttcggtgttgcgattttccccgcttgagaggcgatattgatgatatgtccctttttttgctcaagcatctgcggaagcaccgcttttgtacaggcgatcaggccgaagacattcacatcaaacatcgctttcatgtcatccaatgtagagtctaaaaccgtttcaaatataccgaagcctgcattgttaatcagtacatcaaccgagccgatctgatcgcggacccgggcgatatcctctaggcggccgacatccagaggaaaaatctcacactgtccgctccattcctcggttattttccttttgatttctatcaaacgatcctcgcgtctagccgacagaaggacatgggctccttcagccgcgcataagtatgcgattctttcaccaagccctcctgaagcgccggttatccaaatcctttttcccgctatatgtttcacccatttcacctcttcattgttttaaagtatgcggtatttccttcccaatatgacgtgatggcttcttcagcctccaacacatcaaggtgacctgccgtttctgacatcgttaaaaacaattccttttcatatacagcaggaaaaagctgctgacagacctgaaaagcggtcatcggcttttcatccagcatgcgacgcacatcctccgtcctgttcctctgcttgtcaaaacgcttctcaatcagcgcttgtacactggtgataggctcgccgtgaccaggaaatacgattgttggatcaagttgagacagccttcgcaatgaccgctgataatccactaaaggctttgacctgacgtcccccgctttcggcgcttccaaaatcggattagacgagctgtttgccagcagtagatcgccgccaagcatccttccgcttttttcatggaacagaacgatatgcgattcagcatgtccaggcatctccaacacggaccagccctcaagcccatctatgcccataccttctctgattgtttttgtcagagatctcgtacaggaaaatgcgtacgctgatcgaatcagcttttccgccttccccgtatcaaatggaacgcctaattcaggcagcagcttttgaaaaaaacgtttttgccaatccataaaggcttgatctcggctgatataaggttcgttgaatgtatgcccaatcacttcgatttcatctgaaaagacatcaagcaagcctgcatgatcagcatgatggtgagtcagtacaacctgctcgatatctgacattttcacatttacagcggcaagctgctcttgtagggctctggcagcctcttttgtattcggcccggcatcgataagtgtcagtgcatcaccttttacgaggtaaacgataacatcgccgacagcaaacggcgtcgggacgcggatcgcaattacatcttcagttgtcatcctttcgctccttgtcttcattcattattcatattttagctttttctcggtcttgtgtcattattgcagaatgagaacaaacctttttgaaaaagctattgacattagcttatccgccattgcataatgaacaacaaactaaaacgagaaccattggaacgctatgacgaggaatagtatacaaggcaatggcctaagagagcgatacccccggctgaaaggtgttgcggcccgcttgtttgtagaacctgccctcaagtcgcggttaggaaaacctaaacgtttcccgcgttacgggatttgagctgagcacaatttgtgctaatgagggtggtaccgcgaaccttttcgtcctttacgtgatgaaaaggttttttgttgttctgatagaaggaggatatcaatgaaaaagataggatttgtcggcgccgggtcaatggcagaagcaatgatcaacggcattttgcaaagcggcatcacaaaaccagaacatatctatattacaaatcgctcaaatgacgagcgtctgattgaattaaaggaaacgtacggcgtgcgtccatgcagagataaaaatgagtttttcactcacaccgatatcattatcctcgctttcaaaccgaaagacgcggcggaaagcatcgacagcatccggccgtatatcaaggaccagcttgtcatttcagtacttgcaggccttaccatcgaaaccattcagcattattttggcagaaagctcgcggtcattcgcgtcatgcctaatacatcagcggcaatcagaaaatcagcaaccggattttccgtaagcgctgaagcaagccagaatgatattagtgccgcaaaagctctattgaaaacaatcggtgatgcaacactggttgaggagcgagatcttgacgctgtcactgcaatcgcaggcagcggcccggcctatgtgtatcgttatattgaggcgatggaaaaagcggcacaaaaagtaggattagataaagaaacggcaaaagcactcattttgcagacaatggcaggggcaacagatatgctccttcaaagcggcaaacagccggaaaagctgcgtaaagaaatcaccagtcctgggggcactacagaggcaggtcttcgcgctttacaggactcccgctttgaagaagcaattattcactgtattgaagaaacagctaaacggagcgcagaaatcaaagaacagtttgccgttgccgccttagagagacattcttagatgtaagacaaaaacagaaggcactgtgccttctgttttttatttttcccgcagcagctggccggcagattctgattgctttaatagcgcggagatcgtaaatgaaagcaaatcgggaagcacttcaaaggaataaggcatatacaatctttccgtccatttatgcgggtctttaccagccggaccgacatttaaaaccggaacatataaagcctgatttttaccgcttggcaatgaatatcctctgttaaagagcggcatattgcttgtgtatgcatcaacctcctgtttttccagctgaagataactcaagtccgaaagtccggggaagtactgaacctcccgtaatgcaatgccgtatcgctcagccgcataatgctttatctgatctgctgtatttctgatcaattgatcatcctttgaagaaacagctggataaagcggcggactataaaacagaacgatgagcggcgcatcctccttacaaagcgaagcaagctcagaaacaattttcgtcgaaaaatccctgtctccaagctcccccctgttagcaaaggcataatttagagcccgctctgtttccgagatccccgcacgcttttttgcacgcgagaccagctcatcaaatgtcaaaacagtgacgtcccgctcaatcggctgaaatggctcaaattgttgaaaatcctgtgttttcttccgaacgttcgacatgatttcctccgccgcctgttctgctgttttaagcagcatctgatgcagctcactagctgagcgtttcattgacagcacattaaataatgtgacggctgtatgcggtgtctggactgaatatgcctctttcaagtccttttgcattaagtttaccggcggcggagtgacctcgccatcaaccttttcgcaataatcagcattcagttcaagcaaacggttaatctcagataccattaaatttgcgtttaggcctgaaaacggctctccaacatgtgtctcaatccccttgcagaaaaaacccgcaagcaccttgccaatgcttcctgtataaaaatattgctgctggtcgccgggaaatttttcaaacatcggttcggcattcaggcaagcggttaatgtgatatcatgctttttctccatctccttcaatgcaggaaccgcttcaatcatgcctcttgaattcacttcctcgtccggaaccgttatcaacagcagattgccctcaaaatgcccgttcattgccctctccagcatcgacagttgaatacaaagccccgctttcatatccatcgtccctcttccgaacagccagtctccgctttcggcatctcttctcacacgttccgggagcagctcttttttctctaaaaaggagctcaaaagctcagcaggcttgcaagccatatgtttaaattcgccgtaatcttctatgtcaacgacatcaaaatgactcagcagaagcactgtctttttgacattcttctttttgactagagccgtaagaaaagatctgccatcgtccatcggatgaagtgttacatcatcagggtgcttttgaaaatagggcttgtccttcaaaataaaataaagatactctgcaagcgctgcctcgccctttgaaccggtgatgctttcgtattgcacaagagaagttaaaagtgccagcaattcgtccttcgtctgccaattcattgattccgcccctcctatgaataaaaatgcttctatactgaaaaataaactgatttctcgtctattatacagaaatgtttgacaaaagcggttcatttgagcagtttatatgacgggaaagaaatgacttgatataatcaatctctaaaaaccttacgggaggcgaaagaaatggccagaaaattatttacacctattacaattaaagatatgacgttaaaaaaccgcattgtcatgtcgccaatgtgcatgtattcttctcatgaaaaggacggaaaattaacaccgttccacatggcacattacatatcgcgcgcaatcggccaggtcggactgattattgtagaggcgtcagcggttaaccctcaaggacgaatcactgaccaagacttaggcatttggagcgacgagcatattgaaggctttgcaaaactgactgagcaggtcaaagaacaaggttcaaaaatcggcattcagcttgcccatgccggacgtaaagctgagcttgaaggagatatcttcgctccatcggcgattgcgtttgacgaacaatcagcaacacctgtagaaatgtcagcagaaaaagtaaaagaaacagttcaggagttcaagcaagcggctgcccgcgcaaaagaagccggctttgatgtgattgaaattcatgcggcgcacggatatttaattcatgaatttttgtctccgctttccaaccatcgcacagatgaatacggcggctcacctgaaaaccgctatcgtttcttgagagagatcattgatgaagtcaaacaagtatgggacggtcctttatttgtccgtgtatctgcttctgactacactgacaaaggcttagacattgccgatcacatcggttttgcaaaatggatgaaggagcagggagttgacttaattgactgcagctcaggcgcccttgttcacgcagacattaacgtattccctggctatcaggtcagcttcgctgagaaaatccgtgaacaggcggacatggctactggtgccgtcggcatgattacagacggttcaatggctgaagaaattctgcaaaacggacgtgccgacctcatctttatcggcagagagcttttgcgggatccattctttgcaagaactgctgcgaaacagctcaatacagagattccggcccctgttcaatacgaaagaggctggtaatgccataagagatatcctgtagaggatatctctttttttatttttagagaaacgatcggctaaggttctccgtctccctagtagaaccaattagaggagatgactccaatgaaatcagcttggatggaaaagacatatacaattgacggatgtgcgtttcatacacagcaccggaaaggatcaagcggtgtaacgattgtctttgaggccggctatggtacttcttctgagacgtggaaaccattaatggcggacattgatgatgaatttggcattttcacatatgatcgggcaggcataggaaaaagcgggcaaagcagagctaaacgaacagctgatcaacaagtgaaagaattggagagtttgcttaaagcagctgatgtaaaacctccttatttggctgtttcacactcatacggagctgtcatcaccggtttatgggcctgcaaaaacaagtatgatattatcggcatggtccttcttgacccagctttaggcgattgcgctagctttacctttatacccgaagaaatgcacagatcacatacgagaaagatgatgcttgagggcacacatgcagagttttcaaaaagtctgcaggagctcaaaaagcggcaagtccacttaggaaacatgcctcttcttgtgttgtcatcaggagaacggactgagaaattcgctgctgaacaggagtggcaaaacttgcacagcagcatattgtctctatctaaccaaagcggctggattcaagctaaaaacagctcccacaacatccatcatgatgaacctcatatcgttcacttggctatttatgacgtatggtgcgcagcgtgccagcaggccgctcctctttaccaggcagtcaattaacgtaaaaaaagaccgggccgtaagggattcccggtcttttatattattttgtttcacggtgaagggtatatttctttaaacgcggtgaatattttttcagctccaaacggtctggattggtgcgtttattttttgttgtgatgtaatttcggtctcccgtttcagtgcaggctaaagtaacatttactctcataattaacatctccttataaagcgtaatgattacgttttattatacaacgtcatcacaaattgtcaaataagagctccgccttcagcctcgcgggacgtttacctctaagaaatcatatgccgccacgctattggggaaaacgtcaaccgcttctttttgaagctccaaagaagcatctccctgatatcttgcgctgatatgggttaaaatgagctgcttcgctcttgcttctttcgctgttacagccgcttgttccgttgtactgtgataataatcataagcaagtttacggtcttccttagcaaaggttgcttcatgaacaagcacatcacaatccctcgcaagctcttttagtttgtcacttactctcgtatcaccggagaacacaacagatcttccctttttaggaggctccagaaaatcattcccattgatgattcgtccgtcttcaagcgttaccgtttcgccttttttgattttctgatatacaggtccgggcgggatgttcatttcttttaatacgtcagccttcaaggaacccggtacgtctttttcctgcacacggtacccgaaggcttccactccatgaataacagataccgctgtgacaataaactgatcgtcctcaaacacgattccttcttcaatttcctggatcgcaagcggatatgtcaaatgggttttcgtgacggcaaggcttgtttcaataaacgccttgatccctttaggtccgtacactgtcagctcgtcctctccgccttgaaaggaacggctccccagaagccctggaagtccgtatacatgatcgccgtgcatgtgtgtaataaagattttctctattttacgaggtttaatcgttgtatgtaaaatttgatgctgtgtggcttccccgcagtcaaaaagccataccgaacgcctttcttcaagcaattttaatgccaccgacgttacatttctcgccttggcggggatgccggctcccgtccctaaaaaaagtaattccacgtttccttcctcctactagaaccagatacctacaagaatacaggatcaagctcaaaatgtgaatcttgcctctgaaaagaacaatcctttcgtgctagaaacattttttcagcattctgcttaaaaaagggcttaaatgtttgctttcgttgaattttagatttaaaatgaaggaaatatacggggtgtactaaaataaagcttcgaataaagtgaggtacttttagtgaaaacaaaccaacaaccaaaagcagtaattgtcatattcggtgcaactggagatttagcaaaacgaaaattgtatccgtctattcaccgtttatatcaaaacggacaaatcggagaagagtttgcagtggtaggagttggaagaagaccttggtctaatgaggatcttcgccaaactgttaaaacatccatttcctcatctgcagataagcatatagatgatttcacgtctcatttttactatcacccgtttgacgtgacaaaccctggttcttatcaagagctaaacgtattgcttaaccagctggaagatacatatcaaattcctaacaacagaatgttctacttggcaatggctcctgaattcttcggaacgattgcaaaaacattaaaatcagagggtgtaacagctacaaccggctggtcccgccttgtcatcgaaaaaccgttcggccatgatctgccaagcgcacaggcattgaataaagaaatccgcgaagcatttacggaagatcaaatttacagaatcgaccattatctaggcaaacaaatggttcagaacattgaagtgattcgatttgccaatgcgattttcgaaccgctttggacaaaccgctacatttcaaacattcaaatcacatctagcgaatcactaggcgttgaagaccgcgcaagatattacgaaaaatcaggcgcccttcgcgacatggtgcaaaaccatattatgcagatggttgcccttcttgcaatggagccgcctatcaaattgaacacagaagaaatccgcagcgaaaaagtgaaggtgctgagagcactgcgtcctattgcaaaagacgaagtggatgaatactttgtgcgcggacaatatcaagctggtgaaattgacggtgtaccggttcctgcttatacagatgaagataatgtcgctcctgactccaatacagaaacctttgttgccggcaagctcctgatcgacaacttcagatgggctggtgttccattctacatcagaaccggaaaacgaatgaaagaaaagtccacaaaaattgtcgttcaatttaaggacattccgatgaacctgtactacggtaatgaaaacaacatgaatccgaacttgcttgtcattcatattcagcctgacgaaggcattacgctttacttaaatgctaaaaagcttggcggagcagcacacgcacagccaatcaaactcgattattgcagcaattgcaatgacgagttgaacacccctgaagcatatgaaaaactcattcacgactgtcttcttggcgatgcaacaaactttgcacactgggatgaagttgccctttcttggagctttgtcgactctatttctgaaacatgggcagcaaacaaaaccttatctcctaactacgaatcaggctcaatgggaccgaaagtatctgatgatcttttggcgaaagacggcttacactggtggaatatataataagaagaaaaaagccgaaaatgtttacaagcattttcggcttttttgcagctgtcacagaggtatagcactctcattaataacaaaacccccgaagctctatagctttgggggtttctattgattacttcatccattcagtatggaagatgccttctttgtcagtacgctcatacgtatgagcgccaaagtagtcgcgctgtgcttggattaagtttgcaggcagtacggctgtgcggtagctgtcatagtaggctaatgcgcttgagaatgatggcaccggcacaccttgggcaactgcaagtgaaatcacttggcgaagcgctccttgatagctttctacaatattcttgaaatagctgtcaagaagcaggttgtcaagctcaggctcgcgatcgtaagcttctttgatcttctgaaggaatgccgcgcgaatgatgcaaccaccgcggaagatcatagcgatttcaccatatttcagatcccagttgtattcttcagaagcagctttcatttgggcaaatccttgcgcgtatgaacagattttactcatgaacaacgcttttctgaccgcttcaatcagctcttctttattttctgtaacaggcttcacttctggtcctgaaagaagtccgctcgctttcacacgctcttccttcatagctgagataaagcgtgcgaatacagattcagtaataatcggaagcggaacgcctaagtcaagtgcgctttggcttgtccattttcctgttcctttttgccctgctttatcaagaatcacatcaacaagcggcttgcctgtctcttcgtctttttttgtgaagatgtcagccgtaatctcaatcaggtagctatcaagctcacctttattccattcagcgaaaacttcatgaagctcatcagcagaaaggcccagcacctgtttcagaatgaaatatgattcagagatcagctgcatatctccgtattcaattccgttgtgcaccatttttacgtaatggccggcgccgtccggaccgatatatgtcgtacaaggttctccgtcaacttttgcagaaatggcttcaagaatcggttttacaagctcatgtgcttctttttgtccgccaggcatgatagaaggtcctttaagtgccccttcttctccgccggaaacgcctgttccgataaaatgaatgccgctttcagcgagttctttgttacggcgctgtgtatctttatagtatgtattaccgccgtcaattaaaatatcatccttctctagatgaggaagaagagattgaattgtcgcatctgttgcagttcccgctttaaccattaataagattttgcgcggtgtttccaaggattggacaaattcttcaatgctgtatgtgccaacaacattttttccttttgcctcctgtaaaaactcctcagttttactgcttgatctgttgtaaacagaaacagaaaatccccggctttcgatatttaaagccagatttttacccatgaccgcaagtccgataacgccgatttgttgttttgacatattctaacgtcccttctgcaaacgtttaatcattttaaaatttaaattaaaataaaatgatatttataataaagaaattaccatacattcaccctttttttcaagcgattcagcttttcttttcatcatgaaaaaaatctttattaaagcttgttccctttgttttgctctcctctttttttaacgttgccccttttctgatcagtttggtaccgtactttttattcagcttttccatcatctgctgaataggctcatccttcgcatcttcattaaagctgaacaaatcgagctgtttataggcctgctctttttctactaaatccgttccggtaatgccaagcagcctgacaggatttttattccagtgtttaaaaaagaggtgctccgcttctttcaaaatgtcatttttttgatcaatcgggtttctcagcgtggtgcttcttgtgatggttttccaatccgcatatctaatcataataaaaagcttcgaagccatgacttccttgcgctgtaaacgggcactcacagaagcagcaagctttctaaagacgcctaacagctcttcttcatcactggaatcatgggaaagtgtcgatgagttgccgacgcttttaaattcgtaaatgcgctccgggtcaaccggcgcatggtgaatgccatttgctttatttttaaggcgcggaccgtttatgccaagcaggcgtttcagggagtgttcatcagctgcagctagctctccgattgtatggatgccgagtcccttcagtttttccgctgtctttttgccgactccgtgcatctctccaacaggaagcggccacaggatatcaggcacttgcctctttcttaaaatcgtaattccaagcggttttttcatatcagacgccatcttagcgagaaatttattcggtgcgatccctatgcttgacgggagcagcagctctttttgcagcctgctttggatttcttttgccgtctctagcgcgcggctgctgtatggtgtatcggtcatgtccatatagccttcgtcgatggagacaggctccaccaggtcagtatattcacgaagaatggtaaacatcgctcgtgaagagtttctatagcggtcaaagttcggcggaagaacgatgagctcagggcaatggcgcttcgcttgccaaaccggcatcgttgttttgacgccgcgcgctcttgcttcgtagctgcatgttaccacaatgccctttcgctcctttacgtttccggcaactgcgaccggctttccccggagagccggatcatatgccatttcaaccgacgcataaaagctattcatatcaatatggaaaataattcggctctttcccggcataaacaaatctccttttcggtcattagacaacagcttgtacatatagtaaaatgaagctattgaatggatgtgatgacaatgtttgtggaatcgataaatgacgttttattcttagtcgattttttcacaattattcttcctgctctgacggcaatcgggattgcattcctcttacgagagtgccgtgcgggcgagcaatggaaatcaaaacgaacagatgaacatcagacggtctttcacattaaccgaacagactttcttattattatatatcatcgcattacaacttggatacgtaaagtcttccgcatgaattcgcctgtgaacgatgaggaagacgccggttctcttcttttataaaccgcatttataaaaaggaggagaacaaaattgttaaaaacatatcaaaaacttttggctatgggtatctttttaatcgtattatgctcgggcaatgctgcatttgcagcgactaatcaggtgggaggcctcagcaacgtaggttttttccacgattatttaatcgaaccgttttccgctctgcttaagggtgttgccgggctgtttcacggagaatacggactctctattatcctcgtaaccattattgtgcgtatggttgtactgcctttgtttgttaatcagttcaaaaaacaacgcgtgttccaagagaaaatggccgttattaaacctcaggttgacagcattcaggccaaattgaaaaaaacgaaggaccctgaaaaacaaaaagagctgcaaatggaaatgatgaagctgtatcaagagaacaacatcaatccgcttgctatgggatgcctcccaatgctgattcagtttcctattgtgattgggttttattacgcgattcgctctacacctgaaattgcgtcacactcgtttttatggttcagtttaggacaatctgacattctcgtgtctcttagcgcgggagcaatgtactttatccaggcctatgtcgctcaaaaactgagcgcgaaatattccgctgtcccgcaaaaccctgcggcacagcaatccgcaaaattgatggtgttcatcttccctgtgatgatgacgattttctcgcttaatgttccggcagcccttccgctgtactggtttacaagcggactgtttttgacagtgcaaaacatcgtccttcagatgacgcatcataaaagtaaaaaaacagccgctcttactgagtcggtgaaataaaaaagcaaccccgcgcgaaaagccggggttgttttttgttacttgcaaagcataccgcgccaaacagtcttgtttatcatagctgaagcagaaatggccatccaaaaaatagccgtatcgtttaaaaagaaggaaatagggaatacctttactcacctccaaacgaaaggagcatatacgttgacggaacactttcagcaaaaaaacatttctgtacctgatggaatctggatcatgagacaaacctggaatgatgtcttatttgctcactggcctgttgatgtttctatccttcgcgctttggtaccgtccgttttagaattagatacatataacgggcaagcttggatcagcatgcttccctttatgctcacgaacctaagggcgcgttatcttcctgccattcccggtgcgcgtgcatttcctgagcttaacctccgcacctatgtcacgtataaaggcaagcccggcatttatttttttagcttagatgccgatcatcgtctggcggtccttggcgctcgcacattctttcatctgccttatttttacgcggatatgaagtccgaaaaaaacggtgatgccattgactatgtcagcaagcggaaaaatgacaaagaagcagcattccacgccgcataccggcccatttcagcgccttttacagcagaaaaggattcgctcgattactggctgacagaacggtatagactctatactaccaatcaaaacaaactctattacgaagacatccatcatcatccatggctgctgcaaaacgccgaagcggaaatttcagtcaatacggtgactgatgctcacggcattacattgccagagtcagaccccttgcttcattacgctaaaaaacaggatgtgttattttggccgcttaggaaatggagctaaaaaaacccgatgcgggaaatcgcactcgggttttctttttttattttgccgcctcttcaataatggcaacaaccatttctgccgttttaacgagctcttcgatcggcattttttcattttttgtatggatttgctcataaccgacagcaagattgaccgtcgggatgccatgaccagcgattacgttcgcgtcgcttccgccgccgctcgtttgcagctcgcttggacgtccgattttagcagccgcttttttcgcgatttcaacaacttggtcgccgtcttgatatttaaagcccggatacataacctcaatttcgacttctgcgcgtccgcccatatcagcagctgcctcttcaaaagcagctttcattttttgaacctgagcttccattttctcaggaactaaagagcgcgcttcagcaagaatatgaacttcgtcgcacacaatgtttgtttgtgtgccgccttcaaaccggccgatattagctgttgtttcttcatcgatacggcccaatggcatttttgaaatggctttgctagcgattgtaatcgctgaaatgcctttttcaggttcaaccccggcgtgagcggttttcccgaaaattgccgctcttaccttcgcctgtgtcggcgcggccacaatgatatttccgacttttccgtctgaatcaagagcatagccgtaggatgcagtgatcatagaacggtcaagcgccttcgctccgatcagacccgattcttcccctactgtgatgatgaattcaatcgtgccgcgttcaatgttttcttctttcagcaccttaatcgcctcaaacattgcagccaatcccgctttatcatcagcgcctaaaatcgtcgtgccgtcagttttgacgtaaccgttctctacaactggttttacgccgtttccgggtacaactgtgtccatatgagatgtaaaatagatcgtatctgtttgttttgtcccttttagcgtgcaaatcaggttaccggctccgtggcccgtgatatccattgtatcgtcttctttaacgtccacacctaaatcagaaaattttcgtttcagcactttgcagatttcagcttcgtgctttgtttctgagtcaatttggacaagctctaaaaattcttccagcaggcgtttttcattcaccatttgtaagtccctccatattaaagcggtatgttaccgtgcttttttttcggtctctcttctgtcttatgtgcaagcatatgaaaagcttgaatcagttttccccttgattcttccggcaaaatgatgtcatcgaccattccacaagctgccgctttgtatgggccggcgttttgctttttgtattcagctgttttttcgcgtttcgtcttttgcgggtcagctgaagctttgatttccttttcatacaaaatcgatgccgcaccttctggacccatcactgcgatttcagcattcggccatgcaaacacaaggtccgctccgatcgctttgctgttcatggccacataggcgcctccgtacgcttttctaatgatgagtgtgacttttgggacagtcgcttcagcataagcaaacaataattttgctccatgcctgatgattccattgtgctcttgctgaatacccggcagaaaccccgggacatcttcgacagtcaatagcgggatatcaaatgcgtcacaaaaacggatgaaccttgctgctttatcagcagcgtcaatcgtcaggcttcccgccagatgcttcggctggctcgccacgatgccgattgctttttcacccagccttgcaaacccaatgacaatgttcttcgcaaaaaatggctgaatctcaaaaaaagattgcgggtcagccagctccctaatcaccttccgaacatcataagcctttgtcgtatcagcagggacaagacggtttaataacggtctggacgcctctttctctggcttcggctctgttgtccggccattcagcggcaaataagacagcagttttctcacccctgtcagaacctccttctccgtatgcccggaaaagtgggcgtttccgctgacggcattatgtatccccgctccgcctaagctctccgcatcaacctgttcccctgtcactttttcaatcaccttcgggccggtaataaacatccggccggtctgttcagccataaatataaaatctgtgagtgccggagaatatacagcgcctccagcgcacggccctaaaataaccgatatttgcggaatgactccggaatataagacgtttcggtaaaatatgtgaccgtatccatctaatgataacacaccctcttgaattctcgcaccacctgagtcattcagcccgataatcggcgccttattttttgctgccagatccatcaaagcgcagattttcctggcatgggtttcgccaagcgcccctccgtacactgtgaagtcttgcgcaaatacataaactgagcggccgtcaattgtgccataccctgtcacgaccccatcccctaacatgcgctgttctcttgttaacacttgactttccatgaaggggtgtaattcgataaagctgtcctgatctagaagaaatatgatcctttcccgagcagtgtgcttgcccttttgccgctgctgagccagcttttcccgtcctccgccttcttctgcctgcttgcgtttcgtgtataaatgatccatgtgttcattcatgctcattgtgttggtctcctttcggttcacaaagctctacaagaacaccgtttgtttcccgaggggaaataaacgcgatctttttcccgttcgctccctgtcttggaaacctgtcaatcaattgaacatgctggtcagacaatgcttgaagctgttcagataggccgttgcacaaaaacgcaatatgatgcagtccctgccctttcttctccaaaaataaatggacggggctgtcagctgtcaacggctctatcagctcaagtttgacgctaccagcttgaaaaaaagcaacattcaccttttgctcttcaaccgtttcttgatgaagaaatgcaagccccaatacattttcataaaagcttcttgcatcttttatcgaaaaaacggctatcccgatatggtcaagcctgttcattttcatccctgctttcgctaatagatatcgcttgtccgcccattcaaaacacgctaaaatatagacagattgtttaaggagtgaaaatcatgtctcaaaaactgatgaaaagcgttttgatcgtgattttgggagtttttattctttcaactgtactctcaggaatcgtcatgtttctataacgataaaaaagcaggcgccttattcaatgggaatatcctgcttttttatcagagctttatgctcgatggcaatctcctcaaaagagcggttgtcgtccgtgatcagcactctcgttcctactggtatcgtttgaaacaaatgaacaacctcatcgttatgcatacgtatacagccgttagacacaaattttcctactgattcctctcggtttgtcccatgaattccataaatccgcccgtccgttcctttcgcgtcaaatccgatccatctggccccaagcgggttatcaggagatcccccttcaatatttttctttctgtagtaaggattttccgcttttaccgttaccgaaaactctccttcaggcgtcaaatcatctgtttttccagtcgccacactatacacgccttctactttgttgtcgagaataacagcaagttcatttgttcgcttgttgacaataacatacggatcacctggcagcggattttcgccgagcggccaaatcggtgaaatcatcattaaaatcgaacataagaaaaaacgcataagctcctcctttttcattaggttgaccaatgaaggaagagctcatgcgaatcatccgagtgatttttgcgcttttattcctttaaaataacttttaatcactaaatattgttccatttcgccgagaagatggaagagagcggccctcgcttcaaattcctctctagtcgcaggaagcggcatctcctcaaattcttttctcatgtcagcaagtcttttcagaaatttgtacgctgtattcccagggtgtatcgcctcccgcaaatcatgaataaattcagcgatcatttttccctgatctaccgtgatggagatcgatgtcactttagggagaaggcgttcgataatttcaaattgcttttctctcattttaaaataatgataatgcagattttcgtaacgcaaaatgtggttttgcacatctcgatatgccaggtttttagcctccgtaatgagctggtgcgtttccggaatttcttttcctgaccaatcttgctcaccagttaacaaataccgttcgatttctgcaaaaatgacagcaaagttatcctctatctttttgcggtaggcaatcagtttccggtcaagactaggcatatacaagttcatcaatagagcgacgccgatgccaaccgtaatcagctgaacttcattccagatgaaagcaagcgtaatgccgccggacatgtataaatgaaggataataacggaactggtgacgataccctcgttaatttttaacagaaccgttatcggaatgaatatcaaaagaagcgctccgatcacaaacgggtggtagccaataagctcaaaaaagagataagaaaaaacaattgccagacagcatgccgcaaagcgggcccatgaggcctgaagcgaccgtttttgtgtgatttgtatgcacaaaatggtgatgattcctgctgatgcgaagttttgcaaatgcaataactggcttatataaatagccaaagctgttccaagcgcggtctttattgtgcggtaaccaattttaaacatgtcggactccatttctatttgtttcttcaataaaaaagaagaggcggccagccttcttcttttttatattctataatattttctctaaaaagtcctgcgctcttttggattttggcgacataaaaaattccttcggattgccgtcttcgacaatcattccttggtccataaacagcacacggtctgccacttcttttgcgaagcccatttcatgtgtgacaatcaccatggtcatgccggtttcgaccagctctttcatcacctgtagcacttctttgaccatctctggatcaagggcggaggtcggctcgtcaaacagcatgatgtccggattcatcgcaagagccctggcaatcgcgacacgctgtttttgtccgccagacaaacggtttggatagtcatttcgcttttcaaacaaaccgactttgcggagcaggtcctcagctttctcctgtgcagcctgttttgattctttttttacattgacaggcgcgtacatgatgttttcgagaaccgttttgtgcggaaagagatgaaaatgctgaaaaaccatcccgatgttttcccggacctttaatgtgttggttttcggcttcgtaatctctgtgtcttttattgtaatggttccgccgttaggcttttccaacaggtttaaacagcgtaagaacgttgatttgcctgagcctgaaggaccgatcacggcaacaacctcaccctcagcgattgttgttgaaatgttttttaatacttcgtgtttcccaaatgattttgacagcttttcaaccttaatcattggatttcagcttcctttctacagccttgccgataaacgttaaaatcaggacaagcacataataaatcaatcccgcgataatgagcggctcaaggtaattgtaagtggcggcgccagcttgatatgcgcgtctcatgacatcaccaagcccgatgacggtgacgatcgccgattcttttgttaacgtaattaattcattcacaattgcaggtgatatatttttgaaggcctgcggcagcagcagatccttcatcatttttccatacgggacaccgagtgcaacagcagcttctttttgccctttatcaatggcattgattccggctctgataatttccgatacataagcggcggaattcaaagacaatgcgacaaccgcagcccaaaactggtcaatttgaaatccgagcagctgaggaaggccaaaatagacaatcataagctgcagcactaaaggcgtgcctcggaacactgatgtataaaaatcagcgatccagataaacgggcggaatgtgctgatcttgcataagcttagcacaataccgagtataagtccgataatagcagatacaacaacaatttttaatgtaattgccaagccttctaatataaaaggaatttgggggatcgttgctgaaaaatccaaattcatagcctttgtctccttttcttacaggaaaaaagtttcctattcaataaaaaggctcaacgaaaaagttgagccgcttttttttacttctcgccagtgaaccattttttcttcaatttctcaagctctccgttatcttccatttccttgagcgctttattgaatttgtctgtcagttcactgtcctttctgaaagcaattgctgaaccggcttcttccgctttcgcctcaggaatcacaaagccttgcaggtcatcatttgatttgaaatacccttctgcaacaatgtcttcaataatcgcggcatcgaaacggtcagatttgatttcctgcaccaaatcagaaattctgttgcggtcttctgttttaaaaccatattccggagaaagctctttccccttctcttcctgaatagagccaagctgaacgccaactgtttttcctttcaggtctttcaaagattgaatgccgctgtcttttttgctgacaatcatatggttcgctgtgtaatacacatcggaaaaatcaacttgttttttacgctcaggcgttggtgtcattcctgacagaacgagatccacctgttttgatttaagcgctgtaattaagctgttgaagtccatatcctgcacttcaatttcatagcctgccttctttgccagagcttttgccagctctacatcaaagccgacaatattatctccttctttatattcaaacggtttgtaatccgccgaagtacccataattaattttttctttccgctttctgaacctgaattgcttgagccgcacgcagttaatgcaaaggtgatgcaagcagctacaagtaataagagccattttttcatgatccatttcccccgtattcattacttttggtgtatttgaatatttattcgttaatttgtattttaaacagtttctcatttttatgcaatactatttttaaaaattatctttaagcttatctttccagtgatctcttctgatattactagataaaaattaaatcgctgtacaatccgattgaataatcccttaatatttattcatatatccttagaaatttatgcacaaaaaaacccgggctgctttgagcatccgggttgttcgtcttatacttcttcacaatattcttcaaaggcttcctgcagctttgccactacggccatcggctcatggccttcaatttcatgacgctctaccattttcatgatctttccgtctttcaaaatcgcaaaggacggagaagatggcggataaccttcaaaatagtcacgcgcacgcgctgtcgcttctttatcctgtccggcaaaaacggtgacgagctgatcaggtcttttatcatagtgaacggaatggtaggctgccggtcttgcaattcctccggcgcatccgcaaacagagtttaccatgacgagcgtcgttccttttttcgtaagtgcctcatccacctcttcggctgttttaagctcggtgtatccggcagctgttatttcttgtctcgcttggcggacaatatcattcataaataaattaaagtccatgttcaatgaagacctctcctttttcatcatctgttcttatgatagcaaggaaacgtccatatcggcaaatgactttgcttcgccgtgcactttttttgctcttcgtttactgcttacagaaaaaggggattatataactagaagtaaaataaaggagcagttgtatatgagccacaggaaagcgttactgattcataacggaaatgccggcaacaaaaatatagaaaaagcacttggtgctgtggtgccggttttatctcaccatttagatgaggtaattattaaacagacaaagaaaaaggatgatgcgtatcatttttgccgatccattgatgattctgtcgacaccgtcttcattctcggcggcgacggcacgatccatcaatgcataaatgctatcagcgctctagaaagaaaacccgcggtcggaattttgcccggcggcacgtgcaacgacttttcaagagtgcttggcatccctcaaaatcttgcaaaggctgcggaagcacttatgtcaggaaaaaaaaccagcgtagacgtatgtcagatgaatgaccgttattttttgaatttctgggggatcggcttaattgcagaaacgtcgaatcaaatcaacgaaacggaaaaagcattattgggaaaaatcagctattttacaagtgccttgcgaaccgtctcatccgctgcatcgtttccgatgacattaaaaattgatggagaagaaattaaagaagaagccgttatgctgcttgtgatgaatggccaatatattggaacgaatcgaattcctctccccgatgccagtattgaagatggcttacttgatgttctcatatgccgcaataccaacctcaccgcgttgcgggagctgatgagcatggaacagggttcaattgatcgttttaccggagagttgtcctatgtccaggcttcccgtatcgagattgaaacagacactgccaaaaaggcggatatggatggagaagtttatacacatacacccgcagtcattcaggtcctgccgcagcatatcgacatgcttgttcccgcaaatgaataactgtcatagggctttagaaagattttgcaaatccgttgactctcccctaggaggaggtcttacagtataagggatacacacttgaaaaaggggaagtcatatggagaagaaaaatattaccttaactatattattaaccaatttatttattgcttttttggggatcgggcttgtgattccagtaacgccgaccattatgaatgaattgcatttatcggggaccgcggtcggctatatggttgcctgcttcgctattacacagctcattgtctcaccaatagccggacgatgggttgatcgcttcgggcgcaagatcatgatcataatcggcctgttgttctttagtgtgtcggagtttttgttcggcattggaaaaacagttgagatgttatttatctcccgtatgctgggcggtatcagcgcagccttcattatgcccggggtcacggcttttattgcagatatcacgaccattaaaacacggccaaaagcgctcggttatatgtcagccgctatttcaacaggatttattatcggccccggcatcgggggatttttagcagaagtccattcccggctgccttttttctttgcggcagcttttgcactgttagcagccattttatcaatcctcacgctgcgcgagccggaacgaaaccctgaaaatcaggaaataaaaggacagaagacaggctttaaacgaatttttgcccccatgtatttcatagcttttctcattatcttaatttcgtcttttggtttagcatcatttgaatctttatttgcattattcgtggatcataaattcggatttacggccagcgacattgccattatgattacaggaggagcgattgttggcgccattacgcaagtcgtcttattcgaccgcttcacaagatggtttggcgaaatccatttaattcggtacagcttaattctctctacgagtctggtattcttgctgacaacagtacattcatatgttgcgattctgttggtgacagtcaccgtatttgtcggatttgatctcatgcggcctgcggtaacgacttacctgtcaaagattgcgggaaatgaacaggggtttgccggcggtatgaattcaatgtttacaagtatcggcaatgtattcgggcctattatcggcggaatgctgttcgatattgatgtaaactatcccttctactttgcaacggtcaccttagccatagggattgcactgaccattgcttggaaagcgcctgcacatcttaaagccagcacgtgataagaagcgcattctttgtgtactgcaaagatgcgcttcttctttatactgatgatagaaggagtgatggcatgaaggaatcgtattactcaattggggaagtatcaaaactggcaaacgtgtcgataaaagcgctccgttattacgataaaattgatttatttaaacccgcctacgtcgacccggataccagctaccgctattatacagattctcagctcattcatctggatttgatcaaatcattgaaatatatcggcacacctttagaagagatgaaaaaagcacaggacttagagatggaagaactgtttgctttttataccgagcaggagaggcaaatcagggagaaattagactttttatcagcactggagcagaccatttcattggtgaaaaagcggatgaaacggcagatggaatatcccgcgctcggtgaggtgtttgttttagatgaagaagaaatacggatcattcagacagaggcagaaggaatcgggcctgaaaacgtgctcaacgcctcctacagcaaattaaaaaaatttatcgagtcagcagatggatttacgaacaatagctacggcgctactttctcttttcagccctacaccagcattgatgaaatgacttaccgtcatattttcacgcctgtattgacgaataaacagatttcatcaattacgtcggatatggaaatcacaacaatccctaaagggaggtatgcgtgtatcgcgtataatttttcgcctgaacattattttctcaacttacagaagcttatcaaatatatcgcggaccgccaattaacagttgtcagtgatgtatacgagttaatcataccgattcattactccccgaaaaaacaagaagaatatcgagtcgaaatgaaaatacggatcgctgaataataaagcatagaaaaagagcattttttgaaacaaaacttcaaaaaatgctctttttgcttatttagtaaacagatgtcttctcgtcaatcgattctaaaatttgtttcactcgtccgaggaatcgtccgcacacgagaccgtcaagcactctgtgatctaatgacaggcacagattaaccatgtctctgacagcaatcatgccattgtccatgacaaccgggcgtttgacgatggattctacttgaagaatcgcagcctgagggtagttgataatgcccattgactgaacagagccgaacgaacctgtgttgttgacggtaaacgtgcctccctgcatgtcatctgcagtgagttttccgtctcttacttttttagctaggccggtaatgtctttcgcaatgcctttaattgttttttcatcagcgtttttaatcaccggaacaaataaagaatcctctgtggcaactgcaattgaaatattgatatcctttttctgaataattttgtcccccgcccacatgctattcatttgcgggaattcttttaacgcctgagcgaccgcttttacaaaaaaggcgaagaacgttaaattaaagccttctgtcttcttaaaggaatcttttatactgttgcgatatgcaaccatatttgtgacgtcgacttccatcatcgtccaagcatgcggaatttctgttttgcttcgcttcatattggaagcaattgcttttcttacacctgtgacagggatttctttatcaccggctgcagacgcaggatatgacgtctcttcttttggctcaggttttgatgcagacttcggtgcaggagctgctgttttcggctcctcaggattctgttcttgcacgccgcctgtttcaattaagcgctgaatatcttttcgtgtgatgcgcccgccggcacctgttcctgttacttgttcaagatcaatgctgtgctctccggccaaacggagtacagctggcgagtagcgctttttattgggctgatcagctgcttcggtactttttgcagcaggcgtctcagcggcttttgaagcagctggctgttcttgtttttgttcagccggattcgcgccttctgtttcaattttgcaaatcacttctccgacttgcagggtttggccttcttctcccacaagctctgttatcgtaccagtaaaagaagacggaacctctgcatttaccttatctgtcatgacttccgcgatcggatcgtatttgttcactttatcaccgggggcgacaagccatttgctgatcgtcccctctgttacgctttctccaagctgcggcatcgtcatttgttcaattgccatgattgtatcctcccttacgtctttaaaactccgctaattctctcatcgccgcttccactttatcagggttgaccataaagtatttttccattgtcggcgcataaggcatagccggaatatcaggacctgcaagccgtttgatcggcgcgtctaagtcgaacagacaatgctcggatataattgcggctacttcgctcatgatgctgccttcttttgtatcttctgtgaccaaaagaacctttccagttttggacgcagcttcgataatcgcttctttatcaagcgggtaaactgttcttaaatccaccacatgcgctgaaatgccatctttttcgagacgttctgcagcttgtaaggcaaagtggacacacagaccgtatgtgatcactgtgatgtcgtcgccttcccgttttacgtcagccttgccgattggcaggacataatcatcagccggaacctctccctttatcagacggtacgcccgcttgtgctcaaaaaacagcacggggtcttcgtcacgaactgcggcttttaagagccctttcgcgtcatatggtgttgatggcatgacaattttcagtccgggctggttggcgaaaattgcttcgactgattgagaatgatacaaggctccgtgcacgcctccgccgtatggcgctctgacgacaatcggacaactccagtcattgttgctgcggtagcgaattttagctgcttcagaaataatttggttgactgccggcataatgaaatcagcaaactgcatttcagcaatcggtctcattccgtacattgccgctccgataccgactcctgcgatcgcagattcagcaagcggcgtatccatcacgcgctcttccccaaattgttcatagagtccggctgtcgctttaaacacaccgccttttcttcctacatcttccccaaggacgaagacgcgagaatctcgttccatttcttctttcatcgccaaattgattgcatcaatatatgacattactgacatttgttcttcctccctacttcgcatacacataatcaagcgctgactcaggagctgcataaggggcgttctccgcttcatccgtcgcttcatttacgattgccataatttcatccagcatggtttgttctatctcatcggacagcaggcctgtttcctttaagtaagcttgataagtaagcaggggatcactttttttcgcttcctctacttcttcacgccctctgtagctgctgtcatcgtcatcactggaatgtggtgtaaggcggtaagaaatcgtttcaattaatgtcgggccttctcctctgcgtgccctttcgcgtgcttctttaaccgcttgataaacttccagcgggtcatttccattcacagttacgccaggcatcccatagcctatggcacggtcggaaatgttctcacatgcgacttgcttatcgtaaggcactgagattgcgtatttgttgttttcacacataaaaataaccggcagcttatggacagcggcaaagtttgccccttcatggaaatcgccttggtttgaagacccttccccgaatgtaacaaaggctgcgatatcctttttctccatacgtcccgcaagcgcaataccgactgcgtgcggcacttgcgttgtaaccggagatgatcccgtcacaatgcggtttttcttttgtccgaaatgtcctggcatctggcggcctcctgagttcggatctgctgcttttgcaaacccggacatcattaagtcctttgctgtcatgccaaacgcgagcacgacacccatgtctctgtagtacggcaatacataatccatttcacggtcaagtgcgaaagccgctcctacctgtgctgcttcctgtccttgacaagagattacaaatggaattttgccagaacggtttaacagccacattctttcatcgatttttcttgctaacagcatggttctatacatatcaacggcttcctgatcagtcagccctagtgcttgatgtcggtttatactcattcaagcccctcctttatgcttttaaaaatgaatggctttgccatctgcggcaagcgctgcttctccaattgcttcagaaagcgttggatgcgggtgaatcgtttgcccgacctcccacggcgttgcgtccagcactttggcaagacccgcttcagaaatcatgtcggtgacatgcgggccgatcatatgaacgccgagaatatcatctgtatctcggtccgccacgattttgacaaaaccgtcgctttcaccgtatacaagcgcttttccaatcgccataaatgggaacttgccgattttgacattatgcccgttcgcctttgcttcgtcttctgttaagccgacactggcagcttcagggcttgagtaaatgcacttcggcacaagcgtcggatcaagcggatgcggattgagacctgcaaaatgctcaacagcaataattccctcatgtgaagcaacgtgagctaactgcaggccaccgattacgtctccgattgcataaatatgagattccttcgtttggcagctttcattgactgaaatcatgccattttcagtaacaatatcggtgttctctaggccgatgccttcgatatttgcctgtctgccgatggaaacaagcattttctcagcagagtaggtaacggtttctccgtctttttccgcttgtatgctgatatcgtctgatgtttttgtcattgtgtcaggcagcacttttgcccctgttatgaactggatgccttttttcttaagaagactttccatttcttttgaaatctctagatcttcagtcggcaatatgcgatccgcgtattcaataaccgttaccttcacaccaaaatcatgaagcatagacgcccattcgataccgataacccctccgccgacaatgatgattgattgtggcagctcctccatttggagcgcctcatctgaagtcagtacagacttaccgtccgcttcaagacccggaagcattctcggtcttgatcctgttgcaatgatcacttgtttcgggatcagcatgtcattttcttcgccatttccccgctcaacagaaattgttcccggcagcggagagaagattgacggtccaagaatacgtccatatccggtgtacacgtcaatttttccttttttcattaaatgatttacacccgctgcaagcttatcaacaacggcttgcttacgctgctgcactttttcaaagttgagggacacgccagccgtttccaccccgaattgatcggcttcacgagctgtccggtatacctctgcgcttctaagcagcgctttactcgggatacagcctttatgcagacatgttcctccgagtttttccttttccacaacggctgtttttaagccgagctgagcggctctgatggccgcaacataaccgccggtaccgccgcccagaatgactacgtcatactcagttgccatggtgactcactcctgtctgtctattcaatacgatattgtttggattgctcttcgccctgcaatactctgagcgccccttgggcaagagactgcagttcattttcacccggatagactaaaacgtctgaaatccaatctatgtatgatctgatagcagaaacaaagcttttgccgtacgcaaggcctcccgtcagcacaatcgcttcaacttctccttttaacgctgcgctggctgccccgatttcctttgctacctgatatgccatggcatcataaatgaagcgggctttttcatcgcccccttgaatcatctgttccacttttactgcatcatttgtaccgagatagcctaaaagtccgccggtgccaacaagctttttcatgatttcttcttttgtatattcccctgaaaaacatagatcaacaagatctcccgcaggcactgttcctgctcgttcaggactgaatggtccctcgccgtgcaggccgttattgacatctaccactcgcccgcggtcatggacgccaattgtaatacctccgcccatatgggtaataatcattttcatgttctcatatcgtttgccaagagaggctgccgctttacgagcgacagctttttggtttaacgcatggaaaatgcttttccgttcaatttcaggcatgcctgaaactttcgcaagcactgacatttcgtctacgacaacagggtcgacgatatacgaagggatattcaggccgtcagcgatttcccgcgcgataatgccgccgagattagaagcatgctgaccggcgtaaccgcttttcaagtcctcaatcatgtcatcattcactacgtaggtcccgccttcaattggccggagaaggccgcctcttgcgcagactgcatcaaacttcgagatattgattccctgttcatgaagcgtttcgagaatatggtttttacgaaattcatactgatcaataattcggtcaaatcgctgcagctcttctatgttgtgtctcaatgttttttcaaaaatgcttctttcattatgaaaaacaccgattttcgttgaagttgagcctggattaattgtgagaatgcgtttttcgtcatgtagcactttcataacctccagatcaatttcttaacgtctgcttaatacactgtggccgttttgcaaaaactggcttcttgagcggcgcatgcgttcaatccgttcctctgccaagcggtcagccgctaaatatgcaggaatgccgtcacgctgagaaatctcaagtacacgctcgatattgccgtaaatgccttcaacttttttcaatgcacgttctgcattatagccgtaaagctcatctgccacgttgatgacaccgcccgcgttaatcacgtaatccggtgcataaacgatgcccatttcgtgaatttgatcaccatggcgtgtctcttttaattggttgttagccgcacctgcgatcactttcgccttcagctgtttaatggtgtcgtcgttaatagtcgcaccaagggcacatggcgcataaatatcgcagtcttgtgaataaatatcatcaggatctaccgcccgggcgccaaaatcttcaactgcacgctgtacagattgtttgttgatatccgtaacgattaagtttgctccttcttcatgcaggtggcggcaaaggttataggctacgttcccaacaccctgtacagcaatggtttttccttcaagagagtcggttccgaaagcagctttagctgctgccttcattcctctgtacaccccgtacgctgtgactggggacggatttccagaagagccgaaagcaggagaaatccctgtaacgtagtctgtttcatcatgaatgatatccatatcctcgaccgttgtacccacatcttcagccgtgatgtatctgccattcagcccttgaatatagcggccaaacgcgcggaacatttcttcatttttgtctttgcgcggatcgccgataatgactgtttttccgccgccaaggtttaagcctgccgccgcgttcttataggtcatgcctctagccaatctgagcgcatcttcaattgccgcttcttcattttcatatgtccacattctcgttccgccaagcgccggaccaagcgttgtatcatgaatcgcgataatcgcttttaatccagattgttcatcctggcagaataccaattgttcgtaatcgtatttctccatatatttaaaaagttccatgttcgttcctcctaatgtgtgtattcttcagatgcgcatattgccagcgcaatggaatacagtttattttcagcagagtccgctctgcttgttaaagcaatcggtgcttttgctcctgtaatgacagccgccacgctggccttggcaaaataaatcagtgatttatataaaatattgccggcctcaattgttgggacgagaaggatatctgcgttgcccgctacgtctcccgaaatttttttctgagccgcggcaatttgtgaaactgcgttatccaaagcaagcggtccatcaacaatgcagcctttgatctggccccttttgtacatttgagctagagcagctgcattcacggttgcttccatttttgggttcaccgtttcgaccgctgcaagagcagctgcttttggcatattgttccccactgcatgggccacatgaacggcattttgcaaaatctgccgaagctcttccagcgaaggagcaatattcattgccgaatctgtcacaaacatcagccggtcaaaatccggtatatcgaatacagccacgtgagaaaggacacttgctgaccgaagcccctcctgtctgttcaataccgctttaagcaaaacagaagtcggcacattgcctttcattaaaacgtccgctgttttatgatgcacagcacgaaccgctaatttcgccgattcctcaggagtatcggcatggacgatttccacttgatgcccttgcatggatgatgtcagctcgttcagttttgtgctgtcgcccgttaacaagaaacgggcagataggtgctcggctgccagctttacagcccggatcacttcctcatcctcagcatgagcaaccgcaatggtcttatttttgtgtatcgacgctttgccgattaaatctttcagcttcatctgttaccacctttcttgtttcgactccgccttttattatgcaagttccatgccagctcttaagggtgctgtcataccaggtatattgaaacattcgtgcagatgtttgcgtttattctgcaaattattgcatgccttcatttgcaaggccatatttatccattttgtaatataagttccgaatgctgacaccgagagcttttgctgtttttgtccggttaaaatgatgcttttcgagcgtttgctggatcaaatgtgcttcaaatttttctactgcgacagacagcttttcgccttcaatatccggaaaatcaaaacctgttccctgatctgtgtcattttctttttgctcaagttcgaatacaggcaagtgatctttttcaatccattccatatgcggattcagaaaaatcatggctcgtccaaggacattttcaagctcccggacattcccaggccaatggtaggcagataaggcgcgcaaggcttgttgtgagagcccttttacattcctgccgtaatcccggttgatcttttggataagtctgacgctcaatgcttcaatgtcctccaaccgctgccgcaaaggcgggatggagatcggatagcgattgatccggtaatacaggtcttcccggaatgttccgtccgccatcgccttttcaatatttacatttgtcgccgcaatcactctgacgttgacagggatcgctttcgtgccgcccactctgacgatttccttttcttgaaggacgcgtagcaatttggcctgcatattttgtgtcagctcaccgatttcatctaagaaaatactgccgttatttgcttcctcaaataaaccctttttaccgccgcgtttcgctcctgaaaatgcaccatcctcatagccgaacaattctgattcgagcaggttttcagaaagggctgcacaattcacgcgaataaatttattgtatttccggtcactttcgttatggatggcatgggcgaacagttcttttcctgttcctgattccccgcgcagcaagatggttgccggtgttttcgcaccgagcttcgcctgctcaagcgcaaccagcatttgctcgcttttgccaataatgtcgtcaaacgtgtatttcgcttcaagcgtgcgaataatttgtctggcgcgattaagctccgctgtcagcattttaatttcggaaacatcgtgaatcacgccgacgctgcctttcaaaatcccgtccacaatcaccggtgctacattaacgatgacctctttttcattcgggccgaccttcattctgacaccgcggacaggacgtcttgtttcaagcacctttaaatgcatgctttcgccttcggaaatatcagtgtttgcaggcttgccgatgacttctttttcagaaagccccgtcattttcgtatacgctttattgattagcaggccgatgccgttttcatcaacgacagaaatcgcctcatcggaggattgaataatcgcctccagcatcgtacggacctgctttaagttggtcacttcctctgccagctcgaccgcatcagtgatatctttaaacacacaaagagcaccgagcagacgtccgccttcatcaataatcggcagtcttgtggtcacaatttgcaaatgatcgcctaacagctgcttctggttgtattcaggcactcttgtttttaaaatccgcggcatcttcgtgctcggaatcacttcttttattgggcgcccaatgacttcctcacgtttttttccgaccattttttcggccatatggttaaagagaatgatttcttcattgatatcaataaaaatcattccatcatgggtggaattaaaaattctgtcatatttataggtttgctcttttagcatttgaatcaggtgctgcttttcttccatcagctgaaaaacgatgtatgccatttttcccggcatgacaatggtatcttcatgctttctttgaaggagctcgtcaaacacggcttgatcgccggtggtatgaatgacgatatccggtttttgttgtatgtaaggtttccaatcagatgatacggcaatcccatacttttctgcttctttcaatcccggcgcctcggggtctttgtcaactacggcaatgatatctatgatggctgttttaatcagaatatgtaataacgccgttccccttttgccggcacctactatcagtaccttttgcatcccgatacccctttgtatgaaaaaatttgcacacctatttattccgttgcaataatttgcacaaccctatgttaccacgttttcttctcttgacaaaatattttttccgctggacaataaaggaaatgaaaagataaaggggttttctgaagatgagccgacttcttgcgcttttaatattagtcatccccggggctatttctgctttaggcattaaactgatgagagatacacttttcggccatacaatcaagccattttcagctctttggctccaagggttgtcaggattcatcttttttgcgatcggcctctatgtgctggccgggttcattttatacagagacagaaaacgcaatcaagtcagctcgcgattcagaaaacgatagctgaaaaaaagccggagaatgctccggctttttttgttgcattattcgtcaggcaaaacggtcttggcaatcgttttgtctaacgcttcatagtcataataagaaatcgtatcgtacagttcttttcgtgtctgcatatcatgaagtccttctttttgtgagccgtgctccttcatcaaaccaaacatccgctcacaagcttttgccgccgctcgaagcgaggtgacaggatatatcaccatgtgaaaccccatatcttcgaattcatcggcacgataatatggcgttttcccaaattcagtcatattcgcaaggagcggaacggggatacgctcagcaaactggcggaattcattctccgcctgtagcgcttccgggaaaattgcgtccgctcccgcctcaatgtaagcctctgaacgttttattgcggcatcaagcccttcctgcgccctggcatcagtacgggcaacaacaataagggagggtgccgcttgtttaatggcttttattttttgcgccatttcctttatcggaactagctgtttgccatttaaatgtccgcatttttttgggagctgctggtcttctatttgaacggctgctacccttgcttcaagcatctcccgggctgttcgggcggcatttaagacaccgccaaatcccgtatcgatatccacaagcagaggcagatcagctgcacgtacaagatctttggcccgttcagctatctctgccgatgtgatgatccctaaatcaggcagccccctgctggctgtataggcagcaccggacaaataaatagcagaaaaaccggcttctttcgcaagcaaagcggccatcccgtcatgggcgccgggaatttgaagaatgtccggtgctgacatcagcttgcggaaacgcccggcaagctcctcttgtgacgattgcttattgacgatccacgacatgaaacaaatcccccttttacatgcagaacatgtctacgaattcatttacgcgcatcgtttgtaatgtctcatagctggtacagcgctcataaatgtgtttgtgctgtttatcaggaaaatgggttttgagattgtcagaaaacttttccagcagtttcggcactgcttcctctcttcgaaaacgatggccgaggggaaactcacattccaccatttccgtgctcgttccgtctttaaaatgaacctgaacggcatttgagatggaacgtttatcaggttttaaataatcctcggtatatgttttattttcagtcacttccattttatcacgaagtttatctattctcggatcactcgctgtttcagcttcataatgctgtgcggtgatatcaccaaaaagcaaaccgattgctgtaatgtattggagacagtgatcacggtctgccggattgtggagcgggccttttttatcaatgatacggatagcggattcatgcgttctgatgacaactcggtcaatctcgtcaatccggttctttacctgcgggtgaagaatgacggcgcactccgccgctgtctgggcgtgaaattccgcaggataagacactttaaataacacattttccatgacataagcgtcaagcggacgggcaagcttgatctctttcttattgaataaaacgtcttggaacccccaacccggtgcactcagggctgtcggataacccatttccccttttaacgacatcagcgccaaatgaacacctctgctcgttgcatctcctgccgcccatgatttacgcgagcctgtattcggtgaatggcggtatgtcctcaatgctgcattgtcaatccatgcattcgaaagcgcatttttgatttcttctcttccgccgcccaaaagctttgccgcaacagcggttgtcgcaactttgacaaacagcacatggtcaaggccaactcgatttaagctgttttctaacgccagcacaccttggatctcgtgtgctttgatcatcatctcaagtacgtcgcgtactgttaacggctcttttccttcagacagcctcactcttgatacataatcagcagcggcaaggattcctcccaagttatcggatggatgcccccactccgccgccagccacgtatcgttgtaatcgagccagcgaatcatgcagccgatattaaacgctgccctcacaggatcgagaacatatgacgttcccggcactttgcttccattcggcacagtcgttcctggaacaatcgggccaagcagctttgtgcattccggataccgtagcgccaagatcccgcagcccagggtatccagcaatacatgccccgctgttgtatacgcttcggcactagtaatctctttctcaagcacatagtctgtgatttcttcgataacacgatccgttttcggcattctaccagttcctttcatggttttgtttgatatcgcgggcccatgtaactgacgcggggacggaagagccgattattggcatgctgttcgatcacatgggcgcataaaccggacgttctcgcgctgaaaaagatcggcgtatataaaggaatcggtatgccgagcatccaatacactggggcagcatagtaatccaaattcgggtaaagccctttttccttctccatcagccgctcacccgcttcgcacatctcatataaacgatggtcaccggctttatcgcataattgctgcagcgcctctttcatcatgagtgctctcgggtccatttttttcatatacacccggtggccgaagcccatgattttttcttttcttttcagttttgtttgcaaaagctgctcaaaatcagatgtcgtttttgcctccaaaagcaaatacatcacagcttcgtttgctcctccgtgaagattccctttcagggaagcgacagccccagtcaaagccccataaagatctgaatgtgtagatgcaatgaccctggccgcaaaggttgaattcggcatctcatgctcactgtacaggacgagcgaccggtcaaaaatctgttcttccaatgaagacggcaatttccctgtcatcatgtagagaaaattcgcactgtaggatagggtttgaagcggaagaatcggttctttcttattaatgatcctgtagctggcagcagtgagggcaggcattttcccaagaagctgataggcgcgttctttgtttgcggaaggagaccgatcatcaatttgccgatcatagccagcaagtgccgacaggccggtacgcagactatccattggatgagtgtcctcagggagcagctcaagcagacggagatgatcagcaggcaggcttgaggcactgattattttacgttccagcgtctccatttcactttcttctggcagcctgccctccagcaataaatggacaagctccagatagctttttgtttcagaaagctctattaaatcatagcctcttatcaaaatctggctggactgcgtgtcaagataagaaatatgagtttctgccgcaatcacaccgtccaaccctggagaatattgctgtttctcctccatatcctcaacctccgtttttgcgttttttgtctatcaggttccgccaagcaaatacttggaaataatcagtctttgaatctcgttcgtcccttcataaatttgcgtcacctttgcatcgcgaagcaggcgctcaactggataatccttcatatagccatatcccccataaatttgaacggcgtctaacgccgcctttacggctgcatcggaagcaaattgtttagccatagacgcttcttttccacagtttaggccgcggttatgaaggtctgcagcgtggtagacaagatgtcttgccgcctcagctctagtcgccatatcagccagcttaaatgaaatggcttgattggctgcgatcggccttccaaattgcactcgctgcttcgcataatcaacggcatgctcaagagccgcctctgcaattccgagggcctgtgccgcaatgccgatccggccgacatttaaattcgccatggcaatgtgaaagccatccccctctttgccaagcaaattggcttcaggcacttctgcattatcaaaaatcagttccgtagtattggagccataaagccccagctttctttctttttttccaacggtaaaaccgggtgtgtttttttcaacaataaaagccgaaatcccgtgcctgccttgatctggagctgttaaagcaaatgtgatatagatatcagctgctccgccattcgttatgaatattttcgatccgtttaatagatatttgccgttctttttgattgctgttgtgcggaggctcccggcatccgaccccgagtgaggctccgttagtgcaaatgcgcccaaatggtctcctgacgcgagctttggtatatatttcatcttctgttcttcgttgccgaagtacagaatcggattcgtgccgactgaggtatgaacggagagaatcacgccgacagccgcgctgattctagaaatctcatgaatcgccaaaatataagaaacaacgtctgccccgacaccgccgtactgttccggcaccggtattcccatcaggccgtgttcgcccatttttttgatcagctgaaagggaaattcgtccgttttctccatgatttccgcagcgggagcaatttcttttcgtgcaaaatcacgcaccatttttcgcatcatgacttgctcttgggttacatgcaactcggccacccccggatggaatagacttcaggaagtcctctcctcatagtcataaaaaccgcgtccgctctttttgccaagccagcctgctttgacatacttgcggagcagcgggcatggacggtatttggaatcgccaaggcctgagtgaaggacttccataattgataaacacgtatccagtccgataaaatccgctaatgcaagcggacccatcggatgattcatgcccagcttcatcacttcatctattgcctccggcttcgccactccctcatacacgcaatagatggcttcattaatcattggaagaagcacacggttggaaacaaacccaggaaaatcattgacttctaccgctgttttccccatcttttccgctaatgccataacatctaaggccgtttcttctgatgtagccaagcctcgaatcacttctaccagcttcattacagggacgggattcataaaatgcatgccaataacccgttgaggccggtttgttacagcagcgatttctgtaataggcaaggaagatgtattgctggccaaaatcgtatgaggcgggcaaatgcgatcaagtgttttaaacatctcagtttttgccgccatgttttctgcgatagcctcaatcacaatgtccgcatgctctgcctcctcaagcgtttgagaaatcgaaatgcggttgattacgctcttcacttccgtctcggtcctttttcctttctcagcatcacgggccagctgtttcttcagccgtttcaatcctgcctccgcggcctctggattcacatcatacatccgcacataaaagcccgcgccggcagctgtttgagcaattccgcttcccatctgacctgcgccagctaccatgatttgtttgatttccattcaaatcccctttttcatcatgttttaatgaacctgcactaagacggcgtctccctgtgctgccccgctgcaaatagcggcaacgcccagaccccctccccggcgctttaattcataaacaagcgtcatgagaattctcgccccgctcgcgccgatcgggtggccgagcgcgatcgcaccgccattcacatttactttttcaagatcgaaacctacgattttttcacatgtcaaaacaactgaagcaaaagcttcatttacttcaaacaagtcaatatcttggacagttaaaccattctttttcaggagcttgttaatagcaaaccccggcgctgccgccagctcgtgcgctggcattcccgtagttgaaaaaccaagaattgtagccagaggccgtttgccaagctcagcagctttttcctcagacatcagcacgaacgcgccggctccgtcattgactccaggagcattgccggctgtgatagaaccgtcacttgcataaatcggagcaagttttgcgagctgatccagacttgtgtcacggcgaatcgcttcatctttatcaacaacgtttggttttccttttcgaccgatccagttgacgggaacaatttcatcctgaaacttcccttcatcggcggccttagctgcccttgcatgacttctcaacgcccattcgtcctgctctcttcgtgagattgcatattccttggcagctgtatttccgtgaacagccatgtgcacctcgtcaaatgcgcacgttaatccgtcatacaccattaagtccctaagctcgccgtcccccatccgtgctccccagcgcccggcgggaacggcatacggaatattgctcatgctttccatcccccccgcaacaagtatgtccgcatcctgcgcccgaatcatttgatcacataaagtgacagcgcgaaggccggaagcacagactttattcagtgtttctgacggcacactccaaggcattcccgccagacgggcagcttgacgggaaggtatctgccctgagccggcctggacaaccatgcccatgacgtttccttctacatcatctccagagactccagcccgttgcagcgcctccttcatcacaatgcccccaagctcagcagctttcacctctttcaatactccgccgaatttgccaaatggcgttcttgcagcacttacaatgactgttttcctcatggtttcacctcattcagaagatagacagcgcttacaatttctagttgtcttctatgaatgtatgctttgaaacgggcatgaatgaatgaaaaaagaaggctgcgtcaaacagcctccttctaacaactattcatttttcagcaatgccgaagccttttctggaaagtcggtaaacatgccgtctgctcccgcttcaatgagacgcttcatatcttccggacgattgactgtatacggccttaccttaatcaaaccgttcctcattttcttcagtacttcatctgtgacccctgggctgtttaacttcgggtgatagccggaagccggaatagacgcgatatatcgatctgcctgataaagcacatctgaagttaatactgcccgttcgatatgcggtgcaagccgggcgcacagcgccaagctgtcatgattaaacgtggataggatgactctgtcctctacattaaatcgcttcactgcctccagcactttttcttccattccctcatagcggatcacgctgttttttaattcaatgttgatgagaaaatccttttttaccgcccacgagagcacatcttctagcagcggcacttttatatcgctgtacgcttgatcgtgaccagcggccgcatttgcagtctttacctcatcataggctgtatccttcacgaatcctttaagtgatgtcgtgcgattaagtctttcatcatgaattacaacaatgcgtccgtctttcgtcagctgtacatcaagctctatcccatccgctccggcttcaattcctttttcaaatgcaagcattgtattttcgggaaattgacctgatgccccccgatgggcaaaaatctttgtcatcgtttcacctcaaaccctaaagttttctccattatacttattttgtcggctccactctaggattaaggctgtatcaatctactgatcataataagaatcaatgccgttgacaatcgcatctgcggccttttgctggtattcttcacttcccagcttgtccgcgtcagagctgttcgtgataaacccaagctccgccaacacacttggcatttgtgaatatgtaatgacgtaaaagtctgattctttcacgcccctgtctctcgtttgtaaggaagaaacgagctctgactgaatatcggatgcgagacgccggctgttctccccttcataatcagattgaaaatacgtttctgttcctgaagctgaagcaacccctgaattcacatgaatgctgacaaaaaggtcagcctgattggcacttgccttagccactctttcctccaaggtcagaaaatgatcgtcagaccgggatgcaacaggattggctacctcctcttttagtttgtctgtcacatgctctgagacagccaaattaatatccttttcaaagagcccgtttccgaccgctccactatcttcaccgccgtgtccggcatcaatatacactgttttcccttctatcggctctgctgcctgtgcacaaggcgcgagcgtcaaagccaatccgcacagcgccaagctcctccataacattctcaacttactccctccggtcacgagttctttcgcagctgaatatcttccagctgtaaagttccattatccttctttgtatatttcaccaggacatgtgtctgatctggcagtgattcacattcatcacgtttatccttcggaacttgtatcatggtttcttctccattaagagaaaccgcaatcgtatgaggatcagccgagccaatgtattttccctcttcggtaaaccttggcactgagtcatccgcacttgcaacactgcaccccgaaagaaagagcgcagtaaacagcaaaagaaccgtttgtttcacatgaccacctcttcctgatgtttggcttttatctttgaccagaatggcgaatttgtaaagacaacgcgaatgcaggcgagcaagttccatgattttcaaaagggctatacgacccgatcatttcctgttgttagaaagataacgagcagatttgtctatgaggatggctctaattgaggcgtcaattagaaaaaattagcggaaagaagcaactttttattcattttaaaaaatttgagaatagggtgagcaaatcgtttgacgggtgggtcagccaagcgtaaccttttaaaggatatttactttattgaaagaagttaaaaccatgaaaaaattcgttctgctgctggcggcagctgtcatcacatgctccatcggccaccaaatcagcggcggctacaaaggccccgaaaaagagcggcgaaaacatcactctgcactcaagatattcagtcggtaaagcagatcaattgcattaatttttacatataggctagaatatgtgcgaatccaaacgaaagaagatgatcaaatgaatcctaagtataagccactttttgaaccatttacgtttaaaagcggcgttacaatcaacaaccggatcgcagtagcaccgatgactcattacgcttctaatgaagacggtacaatatctgaagcggagctcgactacatcatcccccgttcaaaagagatgggaatggtgattacagcctgcgcaaatgttacaccggacggaaaagcattccccgggcagccggccatccatgacgattccaacattccaggtttaaaaaagttagcacaagccattcaggcacaaggcgctaaagctgttgtacaaattcatcacggcggtattgagtgcccgtctgagctcgttcctcaacaggatgttgtggggccaagtgacgtgtttgataacggcaaacaaattgctcgcgcattaacagaagaagaagtggaaaacattgtgaaggcgtttggagaagcgacaagacgcgccattgaagtcggctttgacggtgtcgaaattcacggtgcaaacggctacttaattcagcagttttattctccgaaaaccaaccagcgcacggatcgctggggaggaagcgatgaaaaacgattagccttcccgctcgctattgtcgatgaagtgaaaaaagccgcttcagaacatgcgaagggtgcgttcttagtcggctaccgcctgtctccggaagaacctgagacaccgggattgacaatgactgaaacttatacgcttgttgatgctttaggggataaagaattggattatcttcatatctcactgatggacgtgaactcaaaagcgcgccgcggtgcagatccgactcgcacacgcatggacttattgaatgaacgtgtcggaaacaaagtgccgctgatcgccgtcggttccatccattccgctgatgacgcgcttgccgtcatcgaaaacggtattccgctggtcgctatgggacgcgaaattctagttgaccctaactggacggtaaaagtaaaagaaggccgtgaaaagcaaatcgaaacagtgatcaaaggcacagataaagaaaaatatcatttgcctgaaccgctatggcaagcaattgtgaacacacaaggctgggtgccttataaagattaatgtgcaaagactgccgaaacgattcggcagtcttttttccctttatataaatagtttgtgtacacatctaaacagcaaaagaaagagctccccaccaacttcgaaaagaaaatccaggaaaaacccctcacgctttcttgcttttttctttttcattcgtacgtctcctttttacatgaatacgccttacttacgattttgcaggagaaaggtttcattttataacggacacatctagggtcgatcatgcttcgtgatcctataagatgtatgaatggaccaagagtgcaggtaataccgccatttgctttccttacttttcaaacctatcctttactatatgcggatacttaatattcttctcccatactaacaaatgtccccaaaacaaaacgcctcctatttatcagcgcaaactaataaataaaagacgtttgatttaatgaccacttaataagctcatgtttaagaagccttatgttctaatctcagcttatccgcaaccattgcaatgaattccgaatttgtcggtttagcttttgtcatgctgacagtataaccgaacaacgaggaaatggaatcaatgtttcctctgctccatgccacttcaattgcatggcggatcgctctttctacacggcttgcggttgtgttgaattttttggcgatgtccggatagaggacttttgtaatgctgccgagcaattcgatgtcattgtataccattgagattgcttcgcgcagatagagatagcctttaatatgggctgggacgccgatttcatggataatgcttgtgatgctcgcgtcgagatttttcttctttggttcaggctggctgctgcgtataatactgctttgcgatgatggcgcacgatgcgtcacactgctggcatttccgctgacctggcggatatggccgacaaggttttccatatcaaacggtttgagaataaagtaggacgcgcctaaatcgacggcctttttcgtgacatcttcctgtccaaaggctgtcagcataatgacattcggctgttttttcagatctgattccctcagcctctctaaaaccgcaagtccgtctaaatgcggcataataatatctaatacgagcacatcgggatctttttctttaaacagcgacaggcattcctgtccgttataagcaacgccgatcacttccatgtcttcctgtccttctatatattcacttaacaggcttaccagctctcgattatcatcagcaacacaaactttaattttctccacgtttcttcctccccaaatgtagttaacaggattcacccttgctacatgtttacattcgacaaaaccgctatataccctctaaaaaaatcataatcaccaatattagtggcatatctttgttattctatgtttttctctgtttttcgactaaaaatgaaatttgacaaacaaggaaacgtgaatttgtcgaaaaatcttcttttgtatattttaccgtatgtattctgagaagtgaagagggatcaaaataaaaaaactgccggaaactccggcagtcagcttgctttttcttttccataaatatcgattcctgcttctgacagcatccattcaatatgaacaccgtagccgcttgtcgggtcatttacaaatacatgggtgacagcaccgatcacttttccattttgaatgatcgggcttccgctcatcccctgtacgatgcctcctgtttctttcaacagtcttggatcggtaattttcaacaccattccttttgtcgcagggaatttttgcggcgttgtgctgacgatttcaatatcgaatttttctactttgtcatcatcaataacggttaaaatttcagccggcccttttttgacttcggtagaaaacgcaaccggcaatgcttgatctgatatgttgttttgaatcggctgatgcagtgtgccgaaaatcccaaacgggctgtttctgttaatatccccgatcgttttgcgttctgaggaaaatcgcgccagtttttctcccggattaccgcctgtccctttttcaattgatgttacagtggatttaacgatttctccattctccactacaattggtttctttgtgtccatatcggaaatcacgtggccaagtgctccgtatttttttgttttcggttcataaaaggtcatagtgccgatgccggcagcagaatctctgatatataacccgattctgtatttgccttctccttcatccttttctgggatcagcttcgttttgattttctgtttatcacgtttgatcagtaagtctaaagattcaccagttttcccagccttttgaataaatggggctacatcattcattttttcaattttctgtccattcatctcaataatgatgtcgcccgcctcaattcctgccgtttctcccggagattttttgccttcacttgtattgatttgatgaaatccgacgacaagaacaccgacggaatgaagttttacaccgattgattgtccgccaggtataacttttaaatcaggaagaacatgcacttttgtttttttaattggaaatccggcaagatcatataccaattctgactcacctgattttttgcccgtcaccttgatttcatgcggatctttctttactgtaaacgcttctgaggattctgatgtctgagcgtttaccgataaactcgtttcaatcgcttgtgtttgggtttcaaatactctcatttgcgttggaatcagtaaatattcttttagcggtttgcataaacctacacttaataacgaaacaaggagaattaaacctactgcttttctgatgttatcgggcattcactacttcactctcctcgctcctatcccacaccttctttatgacttgctgctacatcatttaattttgccttctgacggcttatttataactgtcatatgaagaaaaacattggatatactgatgaacgaatggatgtgcacgaaaaaaataagctgcgcttctcgcgcagcttacccagttgttttgacttgatccgcttgttttaaaagttctttcgcatggcgtttcgttaaatcggttacctcgacacctgcaatcatgcgcccgatttccgctaccttttcctgcttagacagcggcttgacacgtgtcgtcgttctaccgtcttttaactccttcgcaatataaagatgcgtatcggccatggcagccacctgaggcaggtgtgtaatgcacagcacttgtgaacctattgacaccttatggatcttctcagcgattgcctgtgcgaccctgccgcttacaccggtatcaacctcatcaaaaatgatcgatgtcacatcctgttgtgaggagaaaatgctttttatggcaagcatcacccgtgacagctctccacctgaagcgactttcgaaagggattttagcggctcgcctgtattggttgaaattaaaaacttcaccaggtcaatcccttgttcagtcagctgaacgggctggccgtttacaagcggcgcctcttcattgcgtgacgctgttctgaccttaaattccgtatcaaaagttgatttttccatgtacaggctttttaattcccgatgaatctcatcagccagctttttcgcccatgtttttcggatttgtgacacatttgccgcttccactgcgacatctttgccgacggagtcaagctcctttttcaagctttgaaggtggctgtccctgttttcaatttggtcaatctcttcttcaattttagaagcatattccaaaatgtcttcaacagtggcaccgtattttcgtttcagctgtttgatttcattaagtcgcgtctcaatatagttcaggcgttccggatcaaattcaagctcatccagcatatttctcatctgaaatgtggcatcctcaagcaaatagtaggagttcgaaacactttcagacatttttttcagcggttcgtttatatcagatatatcttcaagctgcgctgatgccattccaacccagtccaatccgccctgctcactgcgaagcgcgttatatgcattttgcagcgactcatatatcttctcaaagtttgaaatttgctggcgctcttcttggagctgttcatcttcgttaagctcaagctttgccgattcgatttcttcgagctgaaattgaataagatcaagacgatgggccatttcctgttcgctttcagaaagctgcttaagctttttgagcagcttcacataccgctggtacccttcctgatacgttttgagcgcgctttccacttcggccccggcaaacttgtccaaaagctggagatgattttcgtcttccattaacagctggttatcgtgctgcccgtgaatatctaataaaagcctgccgatctctcttagtgaagcaatcgtgacaagcttgccattgacacggcaaacgcttttcccgctcgtgctgatatcccttctcatgacgatcatttcgtctgaaacgtcgattccctgctcagcgcatacgcctaaaacaggatggccgctctccaacagaaacagcccttcaagttcggcttttgcttccccatatctaacaaattcagatgatccgcggcctccgactaaaagagaaatggcatctatgatgatggatttgccggctccggtttctcctgttaaaaccgtaagcccgcgttcaaaagaaaccgtcagttcctcaataatggcaaagtttttaatcgatagttcagctaacaaacagcattacacctcttatctttgttagattttctgttacagcagttcaaggagcctgttttttacgccttctgtatcttcaggagtccggcaaataattaaaatcgtatcatctccgcaaatggtccccatcatttcatcccagtccaaattgtccatcagcgccccgattgcctgggcattgcccggcatcgttttcagcacaatcatatggcttgctgagtctattttcacaaatgcgtccatcaatgcccgctttagctttgacagcggattgaaacgctggtccgccggaagactgtatttgtaagaaccattatttgtaggcacttttacaaggtgaagttctttaatatcccgtgataccgtggcctgcgttactttgtatccatcctgctttagcatgtcgaccaattcatcctgtgtttcgatttcattgcttgtaatgatctctctgattttaatatgcctctggcctttgttcatgtaagcacctctatttccaagcttatctgttcttttatgttatatgattctctgcacattgtacatgaatgcagaaaaaaggaataatagcgccctattattccggtacatctgcttttttttcttttaacgtcttatgtgcttcttctacaacgcgcatgatctcttcttccggcagttcctggccttcctgtccctctcccggccaatgcaaatgaaggagaaactcaatatttccgtctcctcccgtgattggagaaaatgacaagcctttacagatatagccttcagcggcagaaaaactgatcattcgcttgagcacatcagcatgcactttaggatctctaacaatcccttttttgccgacggattcccgtcccgcttcaaactgaggcttaactaaagccatgcagtcgctgcccggtacgagcaaagtccttaggacaggcaggatgagccgcagtgaaataaaggacacatcaattgtggcaaactccggcatgccctttgtaaagtctgccggtgttgcataacgaaagttcgtccgttccatcacgacgacccgttcatcctgtctaagcttccatgcaagctgattatagcctacatccacagcgtatgactgtttagctccattttgcaaagcgcagtccgtaaaaccgccggtggaggagccaatatcaatcataattttatctttgacagagacgggaaattccttcaacgctttttcgagctttaagccgcccctgctcacatacctcagcgggtttcctttgacagttaacggaaggtcgcggtcaattttttctccaggcttgtccaagcggttttcgtttgaatagacgatccccgccataatggctcttttggctttttcacgcgtttccgccagccctctttccactaataatacatctaatcgttctttctttgacgtcatgatccaattcctttgtgtgtctttggcggcatcagtaatctaatacgatttgccacctgctgttttgtcagtccaatttcctcaagaagcgctgttacacttccgtgttcaataaaccgatcaggtatacccattctgtcaatcggagtatgatattcaccttgatcatgagcgaattctaaaatcgagcttccgaaaccgccttctaagaccgcttcttcaattgttaaaattggcaagccttcttttaggatactcttcatcatcttttcatcaatcggcttaataaaacgcgcattcacaacgcgcacggaaaggccttctttctgcagctcttcggctgcttcaatcgccatttcgattgttgtgccgaatgttaagatgacagcatcgttccccggacgcagcacctcccacgtaccgatcggaatcgttttcaactgttcatccatttttacgccgagtccgtttccgcgcggaaaacgcatcgctatcgggccttcgtcatagctaagtgctgtatgaaccatatgctggccttcattttcgtctttcggcatcattaagaccatgtttggaatgtggcgcataaacgcaatatcaaacacgccttgatgtgtctctccatcagcgccaacgagtcctgcacggtcaattccaataaacacattggcgttttggcggcagatgtcatggacaacttggtcatatgccctttgcaggaaggttgagtaaatcgccaaaaacggcttcataccctgcattgccatagctgccgccatcgttgcggcatgctgttctgcgattcctacgtcgaacatccggtcagggaattcctttgcgaaaccttcaagctttgaaccgacaggcatagccggcgtaatggctacaatgcgtccgtcctcgcgcgccattcgctgcacagttccgctgacaagaccgctccacgaaggagctgcggctttcggctttacaaagtcaccggtattaattttatatggtccggtaccatgccatgtcccaatcgtatcggtctcagccggtttgtaccccttcccttttttcgtgatgacatgcagaagaacagggcctttcgtttttttggcgtattgaagattctcaatcagctcatgataagaatgtccgtccactggacccaaatacgtaaaaccgagctcctcgaaaaacattccggagacgagcatgtatttcaggctgtctttgactcgttccgccgtggcggcaagcttgcccccaactgccggaatctttttaaataagtattcaagctcatctttgacccactggtatttccccgcagtacggagccgtccgagcatagagtgaatggcaccgacatttggtgcaatactcatttcattatcattaaggatgacaatcatgtcttttttctcgtcgccgatgtggttaagggcttcgagcgccattccgccggtcagcgcgccgtcaccaattatcggaataatatattcatccgttcctttaatatcacgggcagctgccattcccatcgcgcctgacagagaagtcgagctgtgcccggtttcccaaacatcgtgctcgctttcactccgctttggaaatccgcaaagccctttgtactggcgaagcgtcgcgaattcttttcctcgtcctgtcagcagcttatggacatacgattgatggcctacatcccataaaaatttgtctttcgggctgttaaattccttatgcagagcaatagtaagctctacgacacctaagtttgggccgatgtggccgccggaagcggataaacttgtaattaaaaactgacggatttcatcacttaatttctctaattcatcaatggacatgttttttaaaaacgacgggtcctgtattgataaaagatccaaagcggatcaactcactttcagcatgaatttctgcaatgatacatgtcttttgcatgccgagctgacaataatctcagacataaaaaaagacaaacgcgcttttccttttcatttttcatataaactgcttacattttaccatacctcgtgcagccgcttcaaattaggatcgttttagtgatctcttgccgcaattaaatcacaaagctcatataaaaggtctttttgaagagagagtccgccgatcaatcgcttcgcctcttttatatgaacatccaatttatgtttggccccttccaatgaaagaagcgacgggtatgtcgatttgtcatttgtggtatccgagccgacacgtttgccgattttctcttcactgccttctaaatctaaaatatcgtctctgatttgaaatccgattccaatgtggctgctgaaggtacgcagtgtttcaatgtcttcctcaggcgcatcagccaaaatagcaccggcgattacacaaaagccaaggagcttggcagttttccgttcatgaatggattcgagctcttcaagcgtgacttgtcggttttccgcttccatatcagctacttgcccaccgaccatgccttcggtgcctgccgctgaaatcagttcattcacaagccgcaggcgcttttctgctgacacctcgtctgacacgtgggaggtaatcagcttaaagctttctgtgagcagcccgtcacccgctaatactgccgtcgcttcaccaaacactttatggtttgtcggcttcccgcggcgcaaatcgtcatcatccatgcatggaagatcatcatgaattaacgaatacgtgtgaatcatttcgacagcacagcccaccggaatgccgtctttttcgctttttccatatgcatttaaaacagccagtacaatcagaggccgcagccgctttccgccggcctgtagagaatacagcatagatttctttaatgagtccggcatatcaagcttttctgtatagacagaaagctgattttcaattgtttttttccggtccgccagaaagctcgttaatttatttgtcaccttcgtcttcctcctgaacactgaaaggtgccagttcgccgtcttcttttaaaatgaagtccatttgcttttcgactttttgcagcttttcatggcacatttttgacagagccatgccttcttggaaatagttaatggcttgctctagaggcacatctccctcttcaagctttgatacaatgctctcaagccctttcatcgcttcttcaaatgtcatgttttcattttttttcacgtctgtcatttttcttcccctctcttttctaatacttcacaggtcagcacgccatccttcagcttgacttcaagccggtcctgctcttctatttgactgacacttttaatgagtttatcttctttataagccaagctgtatcctctttccatcacttgaagaggacttagtgcattcagcttgccaagaacggtttgaaattgggaatgcagctgcttcatttggatattcatattttttctcagctgatttgtttgttcctggtatcgtgttctcgcttgtttcagctgttcatgaggatgcagtgcctctaatctgtacgtttcacgctccagctgtctgcttttccgatctaaaagagcggtcagctgtgcttgaaactgctggtacgcgaggtcaaactgctgctctttttgcgcatacaaacgctttggaaaacgaaaggcataggacgattgcagcgtttgaatccgttcttttttctggccgaggtgctgctgcatcgctcttgtcattctgacttccgctgtttttgtccgttcgattaaatcagtggtatgaggcacagcaatctcagctgctcctgtcggcgtcgcagctctgatatcggcgacaaaatcactaatcgtaaaatccgtctcatgtccgactgccgatataatcggaatattggaagcaaagatggcgcgtgctacaatttcttcattgaatgcccacagttcttctatcgaaccgccgcctctcccgacaattaatacgtcgcaaatctctttttcatttgcctcttcaatgcgcgtaacgatggatctgctcgcattttcaccttgtacgagcgctggaagaacaatgacttttacaaggggatatcttctttttagagttgtaataacgtctctgacagcggcacccgttggagatgtcacaaccccgattgtggctggaaatgcggggatttgttttttgtagcggtcgtcaaataaaccttctccggcaagcttcttttttaattcttcgtacgctaaataaagcgctccaatcccgtcaggctgcatttctttggcatataattgatagtttccgctcggttcatatacggaaattccgcctctgaccagcactttcattccgttttcaggtttaaaaggcagacgctcgctttgtctcgcgaacatcaccgactgcattcttgcgttttcgtcttttaaagtgaaataaatatgccctcgtgtgtgtatctttacattcgacaattcgcctttaatccaaatattttcaaggtgaggatctacatcgaattttcgttttatatactttgtcagcgctgagacggtcacatacgctgcttcacccatgtctaaaaactcctctcctaagcattcctgcaccataactaaagaaaacccgccctggctttaggagcctgaagaagcgggtatcgtgctcatattcaaggcgggcaaacatttcgcctgtgaatatctccaattatctatgataacgtacgtttcgcagatttaacagtattatgcgcaagcatcgtgatggtcatcggacctactccgcccggaaccggcgtgatgaaggacgctttttcctttgccccttcaaattcaacgtctccgcaaagctttccgttttccagacggttaacgccgacgtcaatgacaacagcgccctctttgatctggtctgcactgatgaagttggctctgccgactgccaccaccaggatgtccgcttttttcgtatgttcagtaatattttctgttcttgaatgacagtaagtaaccgtcgcgttttcatttaataaaagctggccgacaggtttgccgacaatgttgcttcggccgactacaacaacctctttaccggaaaggtcaatattggttttcttcaaaagctcaacaattccatgaggcgtgcaaggaagaaacgtatcttcgccaagcagcattttccctacgtttaacggatgaaaaccgtctacatctttatcaggggagatacgttcgatcaccgctttttcagaaatatggtctgggagcggaagctgaacgagaatgccatgaaactcagggtcttggttatattgatcaataatggaaagcagttcagcttctgtgaggctgctgtcaaattgatcgagcttgaaattcattcccattgtttctgccgcttttttctttcctcgcacgtaagagtgagaagcaggatcatctccaatcaaaataaccgccagtccgggagtgacgccttgctttttaagctcttctacctcttttgccaattgttcgcgtttttctctagccgtttcttttccgtcgatgattgttgcagtcattttctttcctcctatgattgttcaatatcagatttaatgttagaaagaaccccgtttacaaactttgtcgctttgtcatcaccaaaccgttttgccagctcaatcgcttcgttcatggagacattcaccggaatgtcttcggcatatgccatttcatatgctgccaggcgcaaaatcgcacggtcaacattggcaatccgatcgagcttccaattcaccagatgcttggagatcatttcatccagctggtcttggtgttccaataccccgtgtacaagctgttcaaagaaaggatctgttttttcttcatccagtgcgtgttctatggcttcattcactgcaatatcgctgacatcaatttgaaatagtgcctgcaaagctttttctcttgctgttcttcttttcattttctttctcctttgatcctctttatccgcttgtcgttaagccacaaagagatcataacatatttttttcgtatccgcatattgaaatcaaggtttttttaccctattaccgaatattttcacacaccttaatatgattattcggatttcacgttcatgaagaaactcggctatgtaagccggctttcttcatgctttgaaataaagggtaacgtgtaaaaaaaccaaagggccgccctccccttggtttcgtgttaagccatttacatttcttcgtcgatttggacttcttgggcttttgtgtcaaattgaatgccgacgatgtgaatattgatctcgttaatcgaaagagacgtcatatttaataaggtttgacgaatgttttcctgaacggatgctgcaactttcggaatcgaaacgccaaatgtaacgacacagtatacatcgatcgtaattccgtcatccgccaggtcgactttgacacctttgccatgattcactttgccaaagcgctcaacgacgcctgtcgcaaagtttccgcgcatttcggcaactccatcaacttctgatgctgcaatgccggcaatgacctcaatgacctccggtgcaatctcaaccttacccaaatgcgtatcttcgtgatccattttaagcaagctgttgtctttcattcaattcacctccgtaaaaattatgagcccattacatcatatgtttctaaaaatttcgtattaaactctccgctcacaaatgtttcgtgttcaagcagttttaaatggaaagggattgttgtctcaatgccttcgatgacgaattcgctcaatgcgcgcttcatgcgggcaatcgcttcatccctcgtttttccgtatgtgattacctttgcaatcatgctgtcatagtacggtgggatggaatagccagggtacgcagctgaatcgacacggacaccaagaccgccaggaggcaggtacattttaatttcaccaggtgacggcatgaaatttttacttgggttttctgcgttgattcggcattcgatggcccagccttcaaattcaacatcttcttgcttgaggctcagttccattcctgatgccactttgatttgttccttgatcaggtcagttcccgtcaccatttctgtgactgggtgctccacctgaattctcgtgttcatttccatgaagtaatagcgctgttcattgtagtcatagataaattcaactgttccagcacctgtatagccaaccgcttttgcagcctttaccgctgcatctcccatttgctccctgatttctgaatcaagggcaggagatggtgattcttccaaaagcttttgcaggcgtctttggatcgagcagtcgcgttcgcccaaatggatcgtatttccgtagttatcagcaagcacttggatctcaacgtggcgaaaatcttctatgtatttttcgatgtatacacctggattcccaaatgcagttgccgcttcctgctgtgtaatcttaatgccattaatcagttcctcttcagtgcgggcaaccctaattccttttccgcctccgcctgcggtggcttttataattacaggatacccaatttcattagcaagcgaaaccgcttcttccacattttctataattccctgtgaacccggtacgattggcacgccggcctgtttcatcgtttcccgcgcaacgtcttttgttcccatttttgaaatggcgtcagcgctcgggccgacaaacgtgacattcacttcttcacataattcagcgaaatcagcattttcagctaaaaatccgtatcccggatgaatggcgtccgtgccagtcagctttgcaacactcacaatatttgtaacgtttaaatagctgtcttttgatgctttcggtccgatacaaaaagcttcatcggccatttgaacatgaagggcatctttatcagcttctgaataaacagcgacagtctcaattccgagctctctgcaggctctgatgattctgacagcaatttctcctctgttggcgatcaatagctttttaatcatgttcagtctccttactccgcttttacaagaaatagaggttgtccgtattcgaccagctggccgttttctactaatacttcaacgatttcgcctttcacttctgcttcgatttcgttgaaaagcttcatcgcttctacaatgcagacaactgtgttttcatttacttttgaaccggctgttacatacgggccagcttccggtgatgaagaagcataaaatgttcctaccattggtgaagtgattttatgcagattctcatcttgctttggtgcttcttgggcaggtgccgctgcttgctgcgcttgcggctgaactgcctgcggagcctgtgcttgtacaggtgctgccggtgcctgctgcatgacttgaaccgtgcctgcttcgtgttttttcagttttaaggatacaccttcattttcatatacgaattcgtcaattgtagactcgtcaattgctttaatcagctcgtggatttctttgatatttaacattcaatcgcactcctatgtatgaaatttctttttttataggttactgctaaaagtacatactatgttcatcttacaggagcggacttttgaattcaactctaatatgacagcaacgcaaaaagcccgcttgtttagcgggcttttttccctcattcttatttagagggttcaaatgtgacagcgacatctttcattgttttgatttcttttgccacaaggtctataatggctgtcgccttcgatttagagtgtttgtctgatttgactgtaatattgattttatctccttcagcattaacaagcgcatcctcgtaaccttgtgttttaatcagcgtttccagctgtttttctgttccttccacttcactgagagccgtcattttatcgtatgcttcgcttttctccttggctgttgcatcatcgcttgacacaatggcattcagctcttctctttctttgcttctggcatcttctaaatcaagacggtacgttgtaaacaaatcatcatcggctgtttccgtaacaacagttcctttttcactggcttcagcggatgtttccttgtctgctgatgaatctttcgttccctttgttccatcttcttttcctttttcagtttctgtaccgcttttttccttcgtgtcttgcttggcaggcgctttttcagttgcgacctctccgctgtcagacgcgcttttttcactttgcatctgcacggcgtttttgctttccggcgacatgatatagtagacgcttaacaccacgacaagactgagcattgttaatagccaaacggtttgttttttaagcatttatgaatcctcctttatttttttaggggcaaccgcaacccggtggcttggaacatccaggacccgtgtcaccgcttcgataatggtttgttttatttgaacgttgtccactccttgagcaacaacgagtacaccgcgtatatcaggttttttcgtttggacgacgacaggtgtttctttatcgccgtttttgatcatgacgatttcttcctccgatgtttggtctgtaacgcttcttgttccgccttctttgtcagtttcttcggtggttgtatttttgtttgatttgtttttttcgtatactttcagcgacgttgcatctacattcacgacaaccgagacatcgtccacaccaatgattgtttcaagaatttctttcagctgattttcgtattctttttcatagtcatcgatcgagtctttaggtttatcagattttgaggctttaaacacttcagctgttttctctttgctgcccgcggaatgttgcgatgatacggccgttatcgttttggcgttttctgttttctcaggtgaagaaaacagctggctgacaagcataaaggaaactccgagaacaaaaacgaatagaaagtaatgatatttggtcagcttcggcttttcgccgtccttcgtttgtcccggaagaaactgctttttcaatacattccataatccgtttttattcattgccgacactctccccgccttccatatgaaccgtaattttctcacttccgatttcccaaatgtccgcgagctgcgtttgtatctgtttggcttctttttgttcggctgcttctttcgttacgtatgcatgatctgtatcaatgtggaccggcgcgaccgtttggaccgttttttcagaagacggggccatatacacgctgattgttttaatatcctcttctgaatctaccttttctcctgccgtgagtttgatgcggcctactttatattcatcatgactgaatctctcctccgctttcttttttagttggacagccatttcttctagaatatatgcgcgctgggaagcttgtatttctattttttttgaattgatttgattttttatgtcggcagactctgactgcccgttttttgtgagatattcaaagatgatttcggggtctgtcttgaaaagtttaaaaatcggcgtaagcatgacgacaatcaagagcaggctgactaccatttttgcgtacttttgcatgctggagctcggcagcagcatatcaatcacaattgcaaataggataaacaacacgatggtggtaagccattccgttaaaaaactcattcgcctgcctccttcatttcatcatcatcgtgaggtttccggctgtgattatgacagtaaggcttaaaaaaaacatgagagacacaatagcgagagctgcaaaaatataaatgacgcttttgctgatgacgtcgaggcaggtgatgacgggcccgcctcctagcggctgaagaatcgcggctgccagcttataaataaaagcgagggaaagcactttgattgccggaaatgccgcgatacagatcaaaatagcaacaccgagaatccctaccgtatttttcagcagtaaagaggcgctgattactgtatctgttgcgtctgtaaacattcggccaagcacaggaataaaatttccggttataaatttagccgtcctgagcgtaatgccgtctgtcactgcagctgaggctccctgaacagagatgacgccgagaaagatggtaagaaaaacagccagcgctccgatagcgatatttctgagcaggttagccagctgcgttactttgtattgttcggtcatggtgctgacaatgctcagaatcgctgataagaaaatcagcggcatgacgatattctgaatcaagagaccgctcgtgttcatcaggaagaggataacaggatgaaagaaggcagcagatacagctccgcctgaggaagccaaaagcgccaagaggagcggaatgagcgccaggataaagctggtcatcgtctgaatcgcctcagttgcatagttaattgccacatgaaagctattaagcgcaaggataatcagcaccatgtacacaattgagtaagcgaccttactgacggtgctttgctgaaaagcattttgcagaagctgcagaatgacgcaaaaaatcgtgagcaaaatcaatgtgcccagcagctttccgttggcaagcacttcatgaaacaaataagaaaagagagctttcagccattcttgcggtgagaatgatttatcgccattgataaactccattaagctgcctttttggctttccggcagcagtccgccgtattctgtcataatgtcattccaaaattccccgatcttatctgtttcaagcgaggctgctgtcctttccgctaattgctcagctgtttcagcatggtcttccgtttgttctgcattaccagctgcttgtacaatttctgcacggcctgctatgatcagcacggccaaaagcaaaacccattgaaagcgcttcaatctaccgcctcctttcggttatgacatagaaggtataagtccgagaatcgtttcgataatgacggttaaaataggcacagccataacgagaattaaaatttttcccgccaattctattttcgaggcgatggccccttggccggcatcttttgtgagctgcgccccgaattcagcaatataggcgattccgataatctttaaaatggtttcaacatagaccatgttgacatttgcattaatcgcaattttttctatcattcgaataatgtcgtagatttggtctactaaataaagaaaaatggcacatccggcaaaaacgacgattaaaaacgcaaaagtcggcttttgttcttttacaattaaagaaaggaaggtggcgatcagccctaaacctacaatttgaacaatgtcaatctgcaagcccccctatccttggaataaaaacacagcttttatctttttaaataggtcatctacaatcgtggcgaccataaataaaatatagataaaacctaacagcgtcacccactgagcgtattctttcttgcccatctgatccaatatcgtgtgtaaaaaagcgaccacgattcctactccggcaatttgaaatatgacattcacgtctactcccattttatttttgctcccctcacgtttacatcaatagaagaatgagtaacaagcccgctaaaaagcccaaactttttatcattttttcatttttcgcttgcgcctgctcagcatccgcttcagaggcttccaaatgtgtcagcgccagcttgatgtgcttttgctgagagattcgatcatgaatcccgagcgtctcgccaaactgcttcagcacttcgtattcgctttttttcaaagacagggtgtcccataccttctttaagctttgctcccacgccgttttcgcggaatcacttcccttgtccagctgatcactgaatgcggaaaaaagagctgaaacaggctgtgcgagctgtttggcaatctgctgtgaagcagtatgaagcggtgtatggccgtacatgatttcagcctcgagggattgaagcgccgcacgcagctggcggatttgccgcggccgttctgtataaatcttcgccatctcaaaacctgtccatgttgtcgctaccacaataaatacagcgcccagcagcttcagcatgttttcacgcccgtcgtcctagacagcacatttccgtctttgtcataaatttggctcactgtgcccggcccttttgctcttgataattccaaatagcggtcaaaggctctttcttcccacaaacgcttcaatgaaggccgcttcatcaggtcggatatgctccagccatgcgccgatacaattactgaaacaccagcatgcagtgcctccagaagtgcatctgtatcttccatacgcccgatttcatcgacaatcatcacctcagggctcatggatcgaatcatcatcatcagcccttcagcttttggacaggcgtctaacacgtcaattctctgaccaaattgatgttgcggaatgccgcgaagacatccggcaatttctgaccgttcatcgacgattcctgtctttacgggcagcatgggttttttgccggtgcttgagagcctcgcaaggtcccggagaagtgttgttttgccggtttggggcggtccgataatcagcgtattcagccagctgtcttgatataagtatggaagcagcggctccgcaatccccagcttttcccgggcaattcgtatattaaaagatgcgatgtcacggaggcctttcacacctccgttttccgtaatgactctgcccgccagtccgactctgtggccgcctctgatcgtgacataccctttcttcagctcttcttcaagagtatacatactatagttgctaagccggctcaggatcagatgggcatcctctgccgtgcccgcataggacaaataaacaggttgtcctcttcgaatcaattcaacagggcggttgatccgaattctgacttcttcgatttccagccattgttgttccggtatttcagaaagggcgtttttcatggattcggggagaacctcagcgatttcattcaacagagcctcctcctttctaccgattggcttctttaaaatgtatgatgtgaggcagactttatgacaagcctctctttatttatgaacacccgccaaaatcaaaacaacacccgtaaaaatcagaatcagctttgcatacgaaagctgcccggcaatttggtagattccgacagtcatcgtaatgataaaaatcaacggaccgacaatagcgagaatgctgttaaccacaaccgccttccggacatcgttggtcacaagcatgacaattgctgccgtcagctcaatcatagaggataaaactcgtaatcccgccattgttaaaacagtagaattgatatttccaagtaaaaatttcatagcactctcccaacctcccatttttttatatgatatgctctagcttggtgaagtagtcttgtcattttcgtataaaagaaagattctgtttttgggcacaaaaaaagcctgctcccatttgggaacagacttctttttttctttctatgctcttgaaacgtaagaaccgtctgatgtattgacaacaagtgtgtcgccttcattcacaaagaacggcacgtttacaacaagcccggtttcagttttcgcaggttttgtaccgcctgacgctgtatcacctttaataccaggttcagtttcaacaactttcagctcaactgtgtttggaagttcgataccaagtgtttcatcctggtacatcatgatatgcacagacatgttttctagcaggtattttaattcttcttcgatttgagttgcgctcagttcaagctgctcataagaagaagtatccataaatacgtgctgatctccgtttgcatatagatattgcattgttttggtttcgatttgcgctttcgctactttttcaccagcgcggaatgttttttcctgaatggcgccagtgcgaaggttgcggagtttagagcggacaaatgccgcaccttttccaggttttacgtgctggaagtcaacgacgcgccaaatgccgccatctacttcaattgttaatcctgtacggaaatcgttaactgaaatcatgtttaatgtcctcctatattccaatcacaaaataataagttcttttggggaatgggtgattgtccggttgccgttttctgtaatcacgatgtcatcttcaatgcggacaccgcctgtttctggtatgtaaatgcccggctccactgtgaccaccatacccggttcaaggatagctgaagatctgacggataatcccggagattcatgaacttccatgccgagcccgtgcccggttgaatggccgaaatagtcaccgtagccttttacagcaatatgatcccttgtgagggcgtcagcctcttttcctgtcattcccggcttaatatgtgcgacgccaagcgcctgagcatcaaatacaacctgatagatctccttcaattgatcactgggctgacctacagcgaccgtccgggtaatatcagaacaatatcctttataataagcgccaaaatcaagcgtaacaaggtctccgctttcaatcagtttgtcactggccacaccgtgcggaaggcttgaacgaaggcctgaggcgacaatcatatcaaaagaagagctgtctgctccctggcttctcatataaaactccagctcattggcaacagcgatttcagaaataccgggtttcataaacgtcaagatatgtctgaaggcatcatctgcaatcttcgcagcttcctctaatatcttaatctcttcactagacttaatcaagcgcaacttttccacggattcagccacaggcactaattcggcatcactgataacggcgctgtatgaagcgtaagtgccatatgtcatgctgttctgttcaaagccgagacgcttgatgccaaacgattcaacagtgtcggcagtggtctgaatcaagctgccaccatgttcaatgatctcaaaaccctttacctgaaccttcgcctgctcagtataacgaaaatccgtaataaacgctgctttgtcacccgatataacagccaaacccgccgaacctgtaaaccctgtcatatagcgtacattcgtgctgcttgtaatcagcatgccgtcaattcccagctgtccaaacaggtttcttaatttctctagcttcatcttgattctcccccttgctggcttaataagtagcgaacagcaagcttgtagccttcagctccaagaccgacaatctgccctttcgcaacaggagcgataaccgactgatgcctgaattcttccctggcgtataagtttgataaatgcacctctaccacaggaagactgatgcttgaaacagcatccctgatcgcatagctgtaatgactcagggcgccggggttcagaacaatcccgctgtattgctcctcagcctcatgtatcgcatctatcaaatcaccttcgtgattagactggaagaaagtgagctggatatgtaaggcttcagcaaactgaaaaagatctgtttcaatatcggtcagtgtctggcggccgaatacttcaggctcacgactcccaagccggttaacattcggtccgttcaaaatcaaaaaatgaggcacataatctctcctttttgcgagggtttctcatgtaaaaaatgttcacttctcgtgaacattttatcatactggaaaaggattatacactattctctatgcattcccagcgcacgtgcaagcttttccgaattcagctcattgtattcaaatgaaatggaatacccgacaaacagcccgtaaagcaaataaatgcaaatggtcgtaataattgtatctgatgtcagttcggtcaccgtgcgcacatctggaaaaatcggattaaaaacaaaaaacacgagcagccaaagcaccaagccgtataaaatacccggccacattgtttttaaacgtttcaatagaagaaaataaagaaatgctgcgccaattgaaattactccaatcaaaatgatgctgattaccgttcccagcccatgttttttccactctccgagcacaaacggctgcaatatcatattcgggctgatttcggaaaaatgaaacaaatatgcgatataagcaacgaaactccaaagtacgcctccgcaaaaacctgttgccgccaccctgccggccattgaaacaggcggcttttgcttctcattcaattcttcattttgttctgtatctttttcgcttgtcatcatggcacctccagttaaagtgtgcccaaaaaaagaaatgtcaataaaaaagctcacactttttgacagctgcgagtaaaatttgaaaataacgggtataatgcatgtagaaaaagcaaggctatggcaattttttcagcttgtcaatctagaggtttagcgctgtttcctgtacaatagagtgaaaggaaatggttagcaatcctaaagaaataggcaggttgataatatgtcaaaacataaagttccgcccgcttacggcgggcaggctgttgtggaaggcgttatgtttggcggaaagcatcattacgttacagccatcagaagaacggatggaagcattgacttttttaagcttccacgcaaacacaacccgaaactgaacatcgtgaaaaagatcccgtttttacgggggatcgcggccattatcgaagcgagtgcaaacggcacaaagcatttgaatttttcaagcgaacgttacgggctcgatccatctgaagacgagacacttgagcaggaagaaaaaaaatcctccgggctgtctatgtatctcagcctcgcagttataggcgtcctatcatttttgttcagtaaattcgtatttacattggttccagttttcttagctgaactgacaaggccgattttttcctcggacacggcgcaaatcgcggttgaaagcctgtttaagttgattttgctgctcggttacatctattttttgtccatgacaccgcttattaaaagagtgtttcaatatcatggagccgaacataaagtcataaactgttatgaacagaatttgccaattactgtggagaacgtccaaaaccaatctcggcttcattaccgctgcggatcaagctttattttatttacgattattgtcggcatgtttgtttatttactcgttccgacagatccgctttggctgcgtgttatagatcgtgtcgcactgataccggtcgtgcttggtatatcctttgaagttctgcagctgaccaacaaagtgcgtgacattcccggtctgaaattacttgggtacccgggactgtggcttcagctgttaaccacaaaggaacctaaggatgaacaggttgaagttgccatcgaaagctttaacgaacttctcagactcgaagcattgtctgagcaaaatcagaagccttctcacaacgtcatctaaaatccgttgccctgctattactttcggaggtggacagttatgaatcatcgtgtacaacctattattgctgtattaattgcgctgggagcgttcggtttcctctatgtgctggtaaccaatcccggagaaatggcaaaaatggcggtaaccgtcatcgtggcaggtatcattatttattttattgtgaaatatgtaatgaatcgaaatgcgggcagcgaaggagcagccttcaaaaaagcggcgaaacaatcgcggcgccggatgaaagaacataaagcaaaacaccgcgccggacataagggacgtgtcagccacctgcgaagcgttccgagcgccagcaagcctaagccgatgattctcaagaaaaaaagccagactcagctgactgttatagaagggaaaaaaaataaaaagaaaaacagagcgcttttttaataggtccactgctttaaaaacagctctgtccgtcttttacctagctcaatcagggctagttttttttgttgtgttaaatgaaaatcagttgccattacgccatcaaccgggagaaaaatgatattttgttcatagcgtgatgcaatgtgccttgcgtcatgggcatccttcatcgtttcaaacagggcgccgaacagttcaaaagcgttgcggatattttttttcggacgctctctttcacgcggcgcaagcgtcacaccgatcacagggcgctttctttcctttgaaaacagccagatggggaaattgcttaacacacctccgtcgacaaccgtggcggtgcctgtgtccgtttttaattttatcggttcaaaaaaatacggaatgctgcagctcattctgaccgctctggcaaccgggaacatatcgggatttaacccgtaacgggccaaatcgtccggcaaaacaatcatggtgccgtttgtcagatcagaagcaataaggcgcagagaccctttctgcaaatcgccgaaaacccttatgcctttcgctcttaacagatcagcaatccattcttctatcgtatcgcctttgtataagccaagacgccagtagatggacacccactggagcatttttaaggggagaaaagagtacctttgatccagcaatttctctccgtccacttcttcaattaaagcgtggatttccttactggtgtaacctgacgcaatgaaagcggcaataatggcgcccgcgcttgtacccgcaacccttttaaagcggaagcctttttcctcaagcgcttcataagcgcctgcaagcgcaatgccttttactcctccgccggaaaacacaccgtcaatatacatctcattccctccccctccatccgatcgtttattaccattttaagaaaacacgcgcagaaatagaccaactaatgacgggtggcgtcagcgtatcaaaaaagacggcctccttcgagaccgcctttttactgattatgatgttctgttttcttttggattgatttcagatcttttttacgggcatcatcttcttcaaaatattgaacaagatccccgatgcgatcaatactgttccagcttaaatgatgttcgattccttcgacatcgttatatattttctcttcatcaacaccaatgattcttaaaaactgctcaagcaattcatgtctgtataccagccgtttgcctatttttttccctttagacgttaacacgagaccgcgatatttttcataaattaaatattcgtctttatctagtttttgaaccatttttgttacagaggagggatggactgccaatgcttccgcgatatcggaaactcgtgcatatcctttttcttcaatcagcatataaatctgttcaatataatcttccatacttggtgttgtcatcgaaaccctcccaaaaagcaccttaactttataaaccattacaagtttacactaatgaacttgaaaaaacaaggatgctccgcgggtcaaaagccctgtttaccgcttataattccattcatctgaagcgtactttgtttcagccaagtgatgaacaaaatcaagctcttcctgagaaagttcatatggctccaaatgaatgttaagacctgtttcaaatccttctttaaaggctttacgagcctcatccatcgtcacccgcttttcggtgagttcattaatggcaaccgctttgtttttgaaattgcgctgcatccgctctcttactctttcacttggatataagaacagatcgaacagcttgtcctcatctaaatcaagaagaatggagccatgctgaagaatcacacctttttgtctcgtttgcgcgcttcccgccaccttgcgcccctcaaccactagttcataccacgaaggcgcgtcaaaacaaacagatgaccgcggattttttaagctttctttttctttttcagttctcgggatggcaaagtaagcgtccagaccgagatttctaaagccttgaagtatgccttctgaaataacccggtaagcctcagtaacagtcgccggcatctcggggtgctcttccgaaacaattacgctgtatgtcagttcctgatcgtgcagcacacctctcccgccggtcgggcgtctgacgaatccgagattatatttatgtactgcttcaaaattgatttcctttttaatattttgaaaataccctacagaaagtgtcgccggattccagccgtaaaaacggataaccggggggattttcttttcgctgtgccaatataaaagcgcttcatcaagcgccatattgaatgcaggacttgcattgcctgagtctataaaccgccaagtttctttttgcattttaagaccttccttaccgttttaatagaatcagtttatcaaactgtcgggaaaatgaaaaatattttagttccattatagatgacaatcacgctgtgctttactataatagtatttgtcgaaaacggctctatgaccttgttttatgaagcagggttttgattttatatgctaaaggagtagaatcacattgtctaatatgatcgttttgattatttttgctgcgtttatcatctatatgattgcttcatatgtctatcagcagcgaattatgaaaacacttaccgaagaagaattccgcgcgggttaccgcaaagcgcagcttattgacgttcgtgagccaaatgagtttgagggcggacatattttaggcgcccgcaacatcccgctttcccagctgaaacagagaaaaaatgagatccgtacggacaagcctgtttacctgtactgccaaaacagtgtccgcagcggacgcgcggcacaaaccctgcgcaaaaacggctgcactgagatttacaacctaaaaggcggctttaaaaaatggggcggaaagattaaagcgaagaaataaagcaaacagctgtctggtagacagctgtttttatttatctttctaccgcctcgtatctgagcaccgggtgtctcgccgcttttgtttcatccattctttttacaatcgttgtatgcggggcctcctgaacaagttccggattctcctccgcttcttttgcgatttgaatcatagcatcaataaacgcgtccagtgtttcctttgattcggtctctgtcggctcgatcatgatgcattcttcaacattaagcgggaaataaatcgtcggcggatgatagccgaaatcaagcagccgttttgcaatatcaagcgtacgcactcccagctttttctgccgcttccctgataatacaaattcatgcttgcaatggcggtcaaacggaagatcgtaataaggcgcgagttttctcatcatataattggcgtttaacactgcgttctcagtaacagcctttaatccgtcaggccccatggagcgaatatacgtatacgctctcacattaatgccaaagttgccgtaatacggcttcacacggccgatcgcatgagggcggtcataatcaaacgtaaagcgcccttcttttttgactaaaactggctttggcaaataaggaatcagatcttgttttacgccgacagggcctgagccggggcctccgccgccatgagggcctgtgaatgttttatgcaggttgaggtgcaccacgtcaaatcccatatcaccaggtctcgccttgcttaaaacggcatttaaattagcgccgtcataatacagtttcccccccgcttggtgtacaatttccgccatctctgtaatctgctcctcaaacaagccgagcgtgttcggattcgtcagcataagagctgcagtttcttcattcactgctctttttaaatcctctaaatcaacaagccctttttcattcgatttcaccgtaacggtttcaaagcctgctactgttgctgatgcaggattcgtcccatgcgcggaatcagggacaatgaccttcgtccgcttgaaatccccgcgagcttcatgataggcacggatcatcatcagccccgtccattcgccgtgcgctccggcagcaggctgaagcgtaacctcatccattcccgttatttcttcaaggtgtttgcttaaatcatataaaagctctaatgcgccttgcaccgtgtcttcatcctgaagaggatgaatcgcagcaaaaccaggaatacgtgcgattttttcattgattttcggattatatttcatcgtgcaagaaccaagaggataaaaaccggaatccaccccgtgattgcgtttggacagcgctgtataatggcgcatgatgtccagctctgaaacctccggcagcgctgcgtcttcgtcacgaatataggtgtctgacaagaggtcccccaattcgatttccggtacatcgagctccggcagactatagccgattcggccttctcttgaaagttcaaaaataagtgcctggtcctgattactcatggcgatcccccaattcctgaatgagtgcgtcaatttcttcttttgttctcagctccgttacagcaatcagcatatggcagtccagctccggatacgtcaacccaagatcatatccgccaatcatgccttttgccagcaaacgcttgttcacagctctcaccggctcatccagtttgatgacaaattcattaaacatcggcccgtcaaacataacagtaaggcctgctttttttgcttcttgctttgcatagttggcttttaagagattttggcgggctatatcttttacgccgttttttccgagagcagtcatggccactgatgctgcaagcgcatttaaagcttggttcgagcatatatttgatgttgctttatcccggcggatatgctgctccctggcttgcagggtaagcacaaagcctctttttccgttttcgtcttccgtttgtccgacgagacggcccggcacctttctcattaattttttagtaacggcaaaaaagccgcaatgcgggccgccgtatgctgaaggaatgccgaaaggctgcgcatcaccgacgacgatatcagactgaaacttgcccggcggagtgagaagacctagcgccagcgggttagctgaaacaataaacatggatttcccttgatgagcgataggctcaatatcctttagcggctcgatcctgccgaaaaaattcgggtactgaacgatcactgcggctgtgttctcgcaaacggtttggcgcaatgcatcaagatccgtaacgccatccgcagcgggtacttcaacaacatcaatatactgaccttttgcgtacgttttcagcacctctcgcgattcaggatgcacggtttttgacacaacaatttttttctttttcgtgtggcctgaagcaagcattgctgcttctgccaaggctgttccgccgtcatacatcgaggagttggcgatatccatgcctgtcagttcacagatcatcgtttggaattcaaaaatagcctggagctctccttgtgaaatctctggctgataaggcgtatatgcggtataaaactcagagcgcgaaatgacatgatccacaatgacaggctgatagtggtcatatacacccgctcctaagaaagaagcgtattgtacggtatcacgatttttagaggccagctttgtcagttctcttgttaattctgtttctgatttcgcttttttgatttgatactcttttttatatttgacgttttccggtatatcagcaaataaatcatcgatgctgcttacgccgatagtagcaagcatctcctgtttatccttttctgttgcgggcaaataacggtgcttcatgtgttgtctcctctctccaagaaaaaatattagcgtttataaaatggtgttttgacaacctttgctttcactaattttttgcgaatctctacatctacaacagtcccgatctcacttgtttccgaatcaattaaggcaaggccgacgtttttccctaatgtcggtgactgcgtgccggttgtcacctttccgacagacttgccattttggaaaacctcatatccgtgccgcggtatccctttttcaatcatttcgagaccgacaagtttgcgcttcgctccgttttctttttgttcactcaatactgacttaccgaaaaagtcagactccttattgtgctttacagcaaagcctatacctgcttcaatcggtgtaatatcccgggtcagctcctgaccgtagagcgggagcttcgcttcaaaccggagtgtatcacgtgcaccaagaccgcatggaatcaatccgtatgcatcccctgcatcgatgatttttttccaaatatgcatagcatcatcactgcggcagtaaatttcatacccgtcttctcccgtatagccagtgcgtgaaataagtgctttgcggccgctgatatcggcttcatcaataaacgcaaacggctttaatgcagacacatctgcatctgtcagattttttaagaccgcttctgctttcggtccctgtacagccaagagcgcgatttgatctgactggttgtcaatctgtacatcacctgctgcatgttctttcatccaagccaagtctttatctatattagaagcattaatgacaagcagatagcggttctcttctttttgatagataagcaaatcatcgacggttccgccatccgggtaacacatcgctgtatattgagcacggcctggcgttaacgcggaaacatcatttgtcatcaatctttgcaaaaaagacagactgtcgttccctgacacttcgacttctcccatatgagatacatcaaacaaaccggctgcagttcggacagcctcgtgttctttttttatagaagaaaattgaacaggaagctcccagcctccaaaatcaatcgtttttcctccatattccttatacaggtcaaataacggcgttctgttcagcatctaattcctcccctttatcaacggcgcagctaaaaacatacaaaaaaggacagagaaacacctcatgtaaaatgaaggttctctgtcctggcacctgaaagtttactttgcatacgcaaagacgtcccctttggtggtttgcgcatccgcacaaacactctccagagttgcgtcgagcaagagttcttttgcctgagagattcactccgcagtttgctccttcggcgcctgtatcccgaggttttcggtcaggtctctccccttgctgtcattcgctcatattttcatgctgttatggacatactatagcaatatcttacatcaaatacatactcatatcctaccatcatcactatatgctgggcaacagcaatttgggcagatttttcttatattattcatcttaagaatcgaagaattagaaaggcggtttcaaagcaatgaatacagaaatgatctacgatgcaaaatggcctgaagaatttgctgaaagactgaaaaacgatggcccttgggcaaactgggaactgtacaagctctctgcagaaatccagaaaacattagcaattccagattttgaaggcttacgggctcctttatatctgccttcctttacgccgctcccccaccagcttgaagtggcgcaaaaagtggttgaaaaaatgaacgggaaagcgattttagcagatgaggttggtctcgggaaaacggtggaagccggtttaattttaaaagaatatatgattcgcggattagcaaaaaaaattttgatccttgtgcccgcttcccttgtgtcacagtgggtcaaagagcttcaggaaaaatttttgattccggctgttgaacaaaagaaaagctatgtgtgggagcaatgcgatattgtcgtctcatcaatagacaccgcgaagcgctcgccccatcgagaaatcgttctgtctatcccatatgatcttgtcattattgatgaggcacacaaactgaaaaatagcaaaacgaagaactatgaatttgtccggaatctcgtaaaaaaatattgcctgcttcttaccgcgacgccaatccagaaccgtatcgaagagattttcaatttggtgtccttattaaaacccggccatttaggcagtcagaatcactttcaggaggagttcgccaagaagaaatccagtttagaagcgcatgaacatttaaaagatcttgtgaataaagtcatgatccgtaacaggcggcatgatacagggctgaattggaaacagcgccatgttgaaacagtgccgattcaattttctccatcagagcaggcgctttatgatgaaatttctcgcttgaaggaaagtatcaataaaccagccagcatgttctcgattatgaccttgcaaagagaatgctgttcgagcagagaagcggtgtatatgacgctgaaaaagatgctagatcaaaaagagaaacaagcacctgccattgatgaggatacgatttcagttttaatagatcgcatcaatcaagtgacacaaaactctaaagcgcttcaagtcgttgatttgatcaaaaaaatcgacgataaggtcatcatttttacagaataccgtgcaacccagatttatttgcagtggtttcttcagcaaaacggcatcagttctgtgccgtttagaggcggatttaaacgtgggaaaaaagactggatgaaggatcttttccgcgggaaaatccaagtccttattgcaactgaagcaggcggtgagggaattaacctgcaattttgcaatcatatgatcaactatgacctgccatggaacccgatgcgacttgagcaaagaatcggaagaattcacagactcgggcaggagcgtgacgtgcatatttataacatggcgacaaaacatacggtggaagagcatattctaaagcttttatatgaaaaaattcatttgtttgaaaaagtggtcggtgaacttgatgatattttaacgaaaattcaagtgaacaattttgaagagcatctgcatgacattttgtatcactcagcaacagaagaagaaatgaaaataaaaatggataacttaacctcatttttgtcttataaaaaacagcagcctgctgaaaaaagaggatcttagcctgtaaggaggttttattagtgagacagcaagaggttcacgattttctgctgcgtttttttcaagcaaacagctgccaaatcgtcgatcaaggcttaggctatatgacagtgcagcttacagttgaaatggacaaacaaatcatgaaccgccctttctactggcattggcgcgagaagacaggcggtgatccgaatccaatgaaaatcacttttattacagataaagaaaatgcgccaaaagacctagatggtgaatttatatattttggggccccgcgtctttttcaaatatttaaagctgttaaacaaaatgggagatttaccagaatgtatgagaaaattgaatcagccggagctaaagtcccacttcagccttggcttggtataaatgtcacgatttcataccagtccgacatgaaaaaggataagttattgtcactaggtcttcacctagtctctggaacgataattgaagattttcaaagcaagctgacccagttttcactgacgtctcaaatatgtgactattgcttcaccatttcacctatgatcaaaccagaaagcggacttaagcgtatggaaaactatatttccaaatccgctatgcaggagccatccgactgggcggaacaggcggttaacaggtggaagaatgatatgacattgcttgataagttttacgagcatatagaagaaaaaccagaagaataccatctagaaaaacaggcgctgaaaaccttgtatcaaccaaagatatcagttgaaattgaaaatggcggattgttttatctgcaaaataatatttcaagctaacttttttaccattcgacatcattctcgttttttttgagaaaatacgattataataaaggtatattggaaaaaaattctggtgatttaatggcaaatgacttccagagactaatgaagcatacaataagtcatggccggactggctgaaatacataaacaagtattttaggaggagaaactgcatgaagaatgcaaaacaagagcactttgaattggatcaagaatgggttgaattaatggtggaagccaaagaggcaaatatcagcccggaagaaatacgaaaatatttacttttaaacaaaaagtctgctcatcctggtccggcagccagaagtcataccgtaaatcctttctgaatgtgctataatatcacaaggaaggtgatgacattgattggccagcgtattaaacaataccgtaaagaaaaaggctactcactatcagaactagctgaaaaagctggggtagcgaagtcttatttaagctcaatagaacgaaatctacaaacgaacccctccattcaatttctcgaaaaagtctccgctgttctggacgtctcggttcatactttgctcgatgagaaacatgaaaccgaatacgatggtcaattagatagtgaatgggagaaattggttcgcgatgcgatgacatccggggtatcgaaaaaacaatttcgtgaatttttagattatcaaaaatggagaaaatcccaaaaagaggagtagtgcctgagcagaggcactaactcctcttttgtcaataaccatcgagacggcccagtatatgaatactgggccgtctctttttatggctgttattaatttttatcctcgctgtgcgctttttcattttctttcacataaccgtctttatcagtatggtcctttttgattgtcaagccgttccactgtgtagcttcgaacgagaattgaagcttaatggagttgccttgatatttattttgaaccataagcccgttttcatcttttgttttatcatctttgaattggatttccatttgaacctgatcgaagtcagttggtgtttttggaacaccatcatattcaggagcggttttaccgtcaattgttgctacattgactttaccgcttgcatttaagaatttagggtcaatttgttttttgattttttcagtagccgctgcatcatttttagcagacatcaaatacaagtctttaaggttcgcatcatctaaaataatgtttttcgggtaaccattgccgccctcttttccaactgtcaacaatgtcacttcaaactggctgaggaaatcttctggagatgtattgctgccgccgtttgctttaaaatctccataattaagcgccattaaaacttctttgatcgcaagtgatccgttattttcaaattggaaatcctttgtcaacttatctcccggctttagatttgataagttcacactcgctgaattctctttagcagataaatcaagcgtacctgatgcaaaagtagcatcctttgatttaatgtcgttaaatgctgcccatgttcctcctccaactaaagctaatcctagtgctgcagaagcaactcctaaactcaatttctttttcatacccatggtaaactccccttttattgaatgattttatatcgaaacctgttgccaggtttacaactgaagttaagtagacatggtgctgtcctttgtatctgtttccaaggcttttgtctttctttcaatttctctaatggcgctgctgatcgtcacaaaagcgtacactaacagcatcacgccgggaacaatcaataatacagccgttccaatcggctggctggcaaaatgaagcatatagcctgcatatggaagctgaaaacctgtgtattgtgcgcgaacattttcgtccgatacaggcgctgaatcagctgctgcattattatcaccttttgttttaaataacaaatggtctccttgctttgttatgtcaacaattctgtgggtgacagccgtatttgcatcctgcataaatgtaataacgtcacctttttgaagctctttcacatcagcgatttcttttaccaatattaaggaacctgtattgaactccggctccatcgaacctgacagaactgatttcagcgtatacccaaacaccgccggctctcccccggatgaacgtgttgaaatcacgacaagtgtcagcacaataataagagtaaagatgatcacgtataaaatattactgatcagcttcattgcttttttcatcctcttccccgctttccttctggtctgattgagtttcattttctttggttacagcttcttgagatgtttcttctttcattgttttttcctgtatatccttttgtgttgtttcattctcctttttgacgtccgactttgtttcttttttagggactgtcggtttttcatcgcattttgcaagcgtcataggctcggaccactcaaatgtactgccgtttgccgggtagcctgccggtttatatactttaaatgcataaatgccgggtttcatttttttcttcgtctcaattttataaagtgaatcgccgatttgattggagacaaatcctttttcgatcacgttcccatcctttaacggtttgcgggcattttcaagcttatgaagctcccacttccactttgatttcttaagtttctcacctgtattttcgagcacagcaaataaggcgaaaggtgagcatacagtgcctttcgtatccgtttgatctgatatgtgcaaatcactttgatcccagcgtttatcataatggcagtttttatctgtatgctgaaagtctttacacgtttgaagtgagacatcaaatgtttcaatatcatgaaaagcagcgcttgtatcatcggaaaattgtaagcatattgcggcagtcagactgaaaatgactgaaagctgaaagataagcagaactttcagtttcgtcttcgccttttgctgattgtgaaacaatcgaaacatatcttacctcctgtaaaacactgtaacttgatatgacaatcgttctctttaaagaactccacaaatagagtataatcaacgatttatagatttaaaaacaccgaaatcgctcatttcgttcgtttaaaagaatgttttcatcatattacaaagtcttgctcagtattgctcattttttcaattttttagaaatttttgggattgttatgtgagaatttaaatgcatatcccattattatttggtaataataaacaaagaaagggtgacagcatgatgatcaaacaatatgtgatttgtctatctcttctcgtctttggcaccacagccgctcacgcagaagaaacaccgcttgtaaccgcccgccacatgtccaaatgggaagagattgctgtaaaagaagcaaaaaaaaggtacccgctcgcacaggtactgttcaaacaaaaagtatgggaccgtaaaagaaaagatgaagcagtgaagcaataccatttaactctgagggaagggtcaaaagaattcggcgtttttgtaacgatttcatttgatccttatagccaaaaggtcaataaaattgccatattagaagaatatcaataaggtcctccattttttgaaggaccttattcatttatttgcggttattttttccgtttcagccaaagtcggaagccatagggtaaaataccgaaccactgctgggaagcaggcgtttttgtttctttccacacctcttttcgttcttttcgctcatctctcggagtatctatatatttgacaaattgctgcgtcatatatttaacataatcattcgttttcacgtgatcacctcatcattcaattattatgagtgttgtctcacatgactttttttataccctttacactgttttattctgtccatctcagcagctttttctgtttttggtcaaacacgatctgtgcagttctttctgttcccgactccgttgacactcttaagttgatttctttttgttcttttatcgatgtatcatgaatgtaataagaaacccgtccatatggaaattgctgcgtaccctcctggcctttccgttcctctagaacatgccgaatcgaaagaagcaccccattttgaagcaaattctctcctatgtataactcttttgtttccttctcaaacatgcagcgtgaaatatattgagcagcagcaaagttcacgattaacagcacaagcgctgacacaaaaagaacagctgggtaaataaaccctcttgtacaatacattcacccccctcctaaatacgaatagactggaaaagcagtttgatacactttttggtcctcactctcaattttcagcaaaacaacacaattttcaaaatcagctttcatggcagtaatatgatctaaaatcggaacatgccctttaccatccactctttttcttatcattgaatgataaatttcgaaacggatgtcctgcccggaaagattggtgcagattaacacgctcccatgctcggctgtcttaactgcctgtgactccttgcattcattcatcatctgttctatcgaaatcatccattcttgctgtgtgaaaccgtcatgttcctgctgtcgagacaaaaacagatggaaaatcgcagctaacgatcctgatatgagcaaaaagactgagagcgaaaataatacgttaagaagcgtatagccattctgtctgcaggatgctgaggcaatatgatttctctttataagctgtggctttgatacatacgttttgatattcgccctcctcctcccacttcattgcatagatatgattgttctttgtaattgtttttgacgcggctccttcaccactcatgacatatttgctaatgctctcattcatcatctgatagccgatttctcgtgattccgccattttttcatcagctatcagcttgtcccacaaggggacgactgtcagcagcacaaacagccacaggcttagcgcagacattgtttctattgtagaaaaacctttattttctctccacattgactctcccgctccctagataaactgttatatcatatacggcatggccatttactcgtatttttccgcctgcattcgggtgccctttctcattaaattccaaacggtcttttaatgtcagcagttctatagaaagtccccttgcatacggacgttcaatgaccgtatcaccaatgactaattgatattcttttttatgaaagaaaatttttgttctttgttgacgggaaatagcaacctgctgtgtgagcataatatcatttttcagctgccttgctgcctgtcggacagctgtattgtcataagcaggaggaagtgtagtgaagacggccaccaggaggatagaggcaaggcttaacacaagcaaactttctaaaagggtaaacccctcctcctcgtttaatttaatgttcaaccttaacttctccgccggtgatgataatgcgcttaccatttggacagacagcatcgtttttcacatagccctctgactgtaaatcggcaaggctcggagtttgtccttcatgatcaagctcaaatgcagtcatttgtgccttaaccatgttttgtaagccttcacagccctttttttgaatggtttggttatgtttcgtgacgttcggtatcgtaattaaaagcaaaatcgaaataataaagagcacgattaacatttcaacaagtgtaaatcctttctcattcattagcctcttcctttcacatttgattcatcatctgatacataggcacaagcatagataaatacacaagtaagatcatcgctgcaacaaatccataaatcattggctgaaggatgcctgtccatttttgcgctttgtgttccagccgctgtaatatgaattggctgtatgtgaaaagctcccgatccaatcggccgctcagctggccgtgagatatgacttttgataaatcagtttcataaaaagggcttccacaaatagcggattcaattgactcaccggcttttagccgttcaatcaattgttcagcctcgcagcggtagaaagggagaaacgtttgatgtttaaatgcattaaggctgtcataaattgagaggcctgattttaaaaggctgcttagctgcaaagaaaaaaagtagctgttaaacagcttgacaagctttccaaccaaaggaatcctgatacaaatcagcatttgccgggcaggtgattttttcttaaacacaagccaataataaatcccgatacctgctgtaaaaagaacaagcaaaatgatcacaagatcaatatgctgaaaaaaagcaaaaagtatatcggttgaacgtgaggtttccatattcatcgattgatagataccggaaaactgaggaatgatgatggactgtaacatataaaacatgacagcgaccgtaaagatgaggaaaagcggatagcgcagcactcttttcagctggtctgcctgtgcaatttttcgttccagcagctctccgctctggatcatggaagcaggcagttcaccatgtgtttcagcaaaataacaaatacctacggcttccttatgaaatgacaaactctttagtacttgataaaacggagccccttccctcaaacaagtgaccgaatcagtcaagtcagccgcctgcctcttattcatctgaagttccatcaggcgtaatccatccagaagcgtatatccgcccgcagtcatttcaccgagcctctttaataacctcgcttgatcctttaacgaccagacttttctaatctttttcatgataaacccaccggtcatagttgtttgtcgttaaatagccgagcgcaattccttttctgataatttgacgaagcgtttgatattggtaatttgcatgatttccttttgcctcctggatacattgctgaagatttttcccgtatagaagctcataaacgctagctctcctggtatttcgtgactgtcggcaatacactgatgaacatccgttttcacaaaacgggcaagccaaatcaaccaagcgctgagccgctattgcaatgacagtctgttcgatttcattcatattgataccgaattcaagcagtctgtaaattgcgccctttgcgtctctcgtatgaaggctcgttagtaccagatgtcccgtcatcgctgcccgcaccgcaatttcagctgtttccgcgtctctgatctcacctaaaataatcatatcggggtcatggcgcaaaattgctttcagacctgcggaataagttacaccggctttttcattcacctgaacctgaagaacatcttcgtcccttgtttcaacagggtcctctaatgtgacaatatttcgattaaagtgtttttttgcatattgaacgagagagtatagtgtggtagtcttccctgaaccagttggcccggtaaaaatgagcatgccatgggaatgttttaaaaacgagagtaatgtggctcctgtcttcggaaatagcgacaatttatcaatcgaagggatattgtattggggcatcactctgatcacgaggctttcttcattaattgtgggcagcgttgacattcttaaatgaacatttccctctttcagctttaacgtaagcgaaccgttttgcggctttcgcctttcacctatatccattgctgaaagaaatttaaaatgtgaaatcagccttacgcactcttcttttttcatgtccctttttttcagcaaggcatgatcgacccgaaaatgaatgatagcgtcccgctccctcggcacaatgtgaatatcagaagcctttgttagatatgcctcttcaatcaagtttttgcttaccttttctattgaatccaatttgattccctctcctttcaacgcatattgtagaaaaagaagaaagggtaatcaaacaaggaaaacgtgattttgtgagatgttatatgctgaaaaaccaattctttctggcaagaaaaaaaattttcaactgaatgtgccgctgtcattataattttccctataaataaaaaagcagacatggtcaccatgcctgcttgattccattttcattatgctgttttcgctttttgaccagtatctttttcaacggaaaggtcgcctaatgcaacaataccggtcatttggtcattttcaagaatcgataaactgcggatttgatgctctgccataagcgccttgacatcgtatccggtcaccctgatatgtctggtgaaaaagcggggcacgctgcacaaaatatgaaacatcctatagagtccgcctttttcgaggtttctttttcttcttccgctcctgcagcatatctcccgtccagccttttttcctcaaatagagatagatcaggactgtagatgtgacaatcaataagagagaaaagagatatccgtatttccaattcagttccggcatcactgaaaagttcatcccccataaggcacccagagctgtaatcggcgtaaaaagcgtcgtgaaaatggtcagtgcttttacaatttcattccccctgtgtgaggtaatgacttcctctgaatgcagcagattgttaagctccccttcaaattcgctgatgtatgtaaatcccctgtcaattttcagttgtgtccgctgataatcctttttcccttcattttgaggtaaaaaggtttctttcaacgccatttcaatttttttggcgcttaatattaaatttttccaaatcatcagttcatggcgcaggagatggacgcggtttagaatgcttttgctattgtcgtctttaatttgccatctgagctttctcagctttacttcaaattcatcaacaccgattaaatacgcattcattagttcgccgagaagaattaaaaacccctctatcgcattgtccgctctttccatttgccggacaacttctttgcctttaatctctctcaaaatcgaaaagtcaaaattgattgtgaaaaaatattgtctggtgatataaaagtgaaaaacagtatggtctttttcttcaccaagcccctgatcataaacaatcgacccaaataccgcttcattttccgtttcagttgtatctactcgcaaaaaattaacgtgatggttattttcaaaccacttttcacactgaggccagtgagaaaaatggattagatctcttgccttacttctttcttgaggccccatttggtaccaaaaccaatcctttcctgtatgtgccttcatgtcaagatcctccaaacttttgttctttattctttaattgcccaataaccgcgtcactaaaccagtctgccgcttcaacacatgttttatgagcattttcaggtggtatggaatgtagaaagacatcggaaaagggaggtgcatgccttccttggagaaggcagttgttttggaatttatcaatttactagcagtcgctattctcattttgttaacaggattttttgttgccgtagaattttcaatcgtaaaagtgcggcgatccaaaattgatcagcttgtcgcaaaaggaaagaaaggttctaaagcggcaaagcatgtcatcactcaccttgatgaatatttatcagcctgtcagctgggcatcacagtcgcagctttaggactgggatggcttggggaaccgactgtgcaaactctgcttcgaccgctttttcataaagcaggcttaaatgaatcgcttacccacctgctttcactcgtcatcgcatttttagtggttacgtatttaaatgtcgttattggggagctggctccaaagagtttcgccattcaaaaagcagaaagcattaccttgttgttcgctaaaccgcttatttggttttataagatcatgtttccattcatttggctgttgaaccactctgcccgattgattacaggagtgtttggactgaagccggcatcagagcacgagctggcatatacagaggaagaacttcgggtcctattggctgaaagctataaaagcggcgagattagaaaaagtgaattaaagtacatgaataatatcttcacctttgataaacgaatggcaaaggaaattatggtgccgcgaaatgaaatggttagtttatcactagatgaagactccatttcaaatcttcaggaaacagtcaagcaaacaaaatatacacggtacccagttgtaagagaggataaagataacgttattggcgtgattaatatgaaagaagtgctgttttccatgctgacgaaagatttttcaatcaagaagcatcaaattgaacctttcgtacagcccgttatccatgtcattgagacgattcctatttataaactactgctgaaaatgcaaaaggaacgcactcatatggcgatcctcatcgatgaatatggcgggacgtccggtttggtcactgtcgaagatattatcgaggaaattgtaggagaaatccgtgatgaatttgatgcggatgaagtgcctcatatccgcgaacttggaaaggatcattacttgttaaatgcaaaattattaatcagcgatgttaacagcctgcttggaactgatttatcagacgctgaagtagacaccttgggcggctggtttttgacacaaaacatagacgctgagcctgaaagtaccatagaatatgatggctactcttttaaggtaaaagacatcaacagccatcacattttatttatagaagtaaaaaaagctgaatagcccgtgaaaggctgttcagctgctatctttcaagataaacatggcaaaggcatcaacactcttttattttaaaccctttattggccagggctttagcaagactttgctcggttttcacattcgaaaaatccagacccagcttcacgacagtttgggcaatttccggcctgattcctgaaataatcgtctcaatgccgagcaatttggtgctgtcaatcactttaaaaatttgataggctaccatggtatcaacgataggaacgcccgaaatatctaaaaataaatacgagagctttaacgctgagcactgctccagcacagactccaaaatcgtcctcgctctgtgcgtatcaatttcaccgacaagcggaagaatcccaattccatcagtaatcggcataatcggcgcactcaattcattaatcatttctttttgcgcgtttaattgtatcatggtcacctggtgatattcttccgtaaacacttcgatgatctcatcaatgttttgattcaagatccggctccactcataaaattcctgaatgctgatgtcttgagaagaagcttcgctgaatttatgaatccattcaaacatgatgtgcctgaaagtgttaaactggccgacactttgtgtaaccgtcacttcatgaacggcacggtctctggcgcattgaagagaccaccggttgagctcatcctctacgtcttcttttctaagggattttgctacgatggtcaccaataattcatgctggtcttttaacttttgttctagtttttgctgatctttcgctgaatacagccagctgcctgttgatgtacaaactttcagccattgttgcgtgatatcttctttgtgctctgttaagtgctgatcaagagctatcatcttaatgagctacctcctgtttttgaaaaatgtacgctatatatgtataacgcgtctgcctttacacatactatgtttagattcaatgggctatagccaagcggtaaggcaatggactttgactccgtgatcgttggttcgaatccagctagcccagtttctgaacaggtgaaaaaccgaagacaagctgattcgaataaatcagcggatcttcggtttttcatcatgcagattgatgaaccgttttcttcttcgataacttcaacagttctcccgggttataaccaatcaccagctttttgttgtctactagaatcgggcgtcgcaaaagcttcggcttctcgattaaaagttccagcacctcatttaccgtcatttcttcaatgtttaaatttaaatttttgaaagtctggcttcttgtcgccaaaatttcatcaattccttctgtcgttaacgataaaatgtactttaattcttctcttgtcggggtttctctgaataagtgccgttcgttaaattcaatttgatgtgctttaagccaatgttttgtttttcggcatgacgtgcagcttggatatgagtaaaaagttaattgttgttccattcgttttttcctcctcagttaaccatctctttgtagaataactacccggatcatttttcatttaaaccatttacagaacttttttcggattatttttttaaaaacattcatacaatagaaaacacaatcaaagggacaaattccatttgtatattaataatgaaaatgtttacatttctaggtgtgatccattataataacagtcagagggactctcgggaggggataaaaatgaatcgcatgttccgggtgttaggattttggacgggaatttttgcagtcatgttttatttaggtgatatgaaagatgcttcccttttattttttggacagacgatcttatttgtgtttctatcgtatttgaacttaaccgaacgcatgtatatttatatttttggcgcttatttaacaattttcttcgccggctttacatattactcaatttttattatggtgcccggcggcggaggccattaaatgcagaaagagacaaaccttatcggtttgtctctttttttacaatgaaaacccatttaaaaacggattttggtcctgctcagtcagtacgtctgtttcaggtccatggccgcttaacaccagcgtgtgttccggaagtgtaagcagtttttcatgaatggacgtcagcagcgtctcttgattgccgcctattaaatccgtacgtcctataccgccttggaacaagacatctccggagataaccaagtctgcatctttcacgtagtaagacacactgcctggtgaatgtcccggcgtaaataatgtttccaaatgaaacggcccgatattcaactcaccgtcgccttcaattagatgatctgcaggcttagctgttacttctatccctcgcagcatgccggagccgtttaaagaagcgtccgtaagccaatttttttcattttgatgcaggtaaacagggatatcccatttttctctcacttcatcaagcgccccaatatggtcaaaatgggcatgtgtaagcaaaatggctaaaggcgtcagccctttttcttttatgtattgattgattttatgtccctcgccgcccggatcaaaaatcaggcattgatcatcattgatgagaaaatatgcgttcgcttgaatcggccctactggcattcgtctccatttcactattatcacctctttcttttttatgctcttattatgagggttttttaaaaaagattcaaacaatcgcaatgaaaacgctatcgacaaacctataaaaaacaggtagaataaaactggaaagaattgcaggtttttcaatgtaaagggggctgtgttatgttacttgtcgtgattttcggccttgtcgctcttttcgctttatggggagtcttgcgttctgttagaaataaaaatatactcgggtttttattagccggtgccaccttatttgtctttggatggtttaccgtgatgaccgtaataaacagcgggtatccaaccgcacattaaaacctgtatccgatcggatacaggtttatttttatggctgtaaatgtttattgacactttctattttgctctcaagcgtcgtttttttgtcacgcctgtcatcgatacggatattcgttgccactctgtgcaatcctttttgaaatggcgcttcgtgaattgcctgaatgactgcaaaaaggtcactgagttctccctcgatcagcgtattcatcggtgtcagctgatatttgattttcccttctgcttgatatccttctaatatcttttgcacatcggctacgtaagcactgacactgggtgtttccgtaccgattgggataatggttacatctgcgatagccatcgttattccatctccttttgatcaatgatgagttgcttcgtttcatgtgatttcaataaaataatttgctcaaaatgaaagccgtataacgcatatttcccgttcggagatatttgaatcggctccatttcccgcagagacacaagatcttttgtctctcccgatgctacattgattgctgcgagcttatatgcatcgccgctttgtttgaatgtataaaacaggcttcctgcttcatcatagtcatactccattggagccaaacttgtatatttcgcttggagcggccatttcgctgtaacaggtgatgttgattgcggcgttttaaactgatacgtcccttttcctccggaagctgatttgacagtaaaactcatttgatggaaagaatcgaagaatagaacgttatcctcaagcttctgttccgtcttagaagctgtatcgaacgtatataaaggccctgttttatcgtctcttccctcttttacataatcaaatgtatttttggatgtccaatgaatgaacggaacctgtactgggcttaagaaagattcgtcttttttagcattcacctgatatgtatggaaatcccagttttcattgaattccgtcaccatcatttgataaggatcatactgattccaagcagcttcaagctcatacgtttcgtaatctttttcgtaaagcgtctctccttctgcattaagcaaaaccactgccgtcttttggctatgtgtgatttgcagcagaatcatctgctccctcgcattgatttgaacatcaacgatttgaccatccgtttgatagagctttttcgctttgcctgtaaagatgcggtacgcaaaaagctctgttttcgtcggattagacgcagtatataatattgtgctgttattcagccagccttccaccccatccgctttttccgcggaaagcggtatgatgtcttttttctcatcttttgccgccgatgcctgtttttgctgctgatgagatggttcgcatgccgataaactaaacagcaataccgccagcagaataaaacaaactgatctcatcagcattcccctccgatcatctttattctctcatatttgcttcggcagaaaaaagaaaaagtttcagttactcatgaaaaaataacgccctccacaagataccgcttgtggcgttatatatgtgtgaaaactgctgaaacggcaaaggattttggccttttccaagttccaccgtatacccttccttaaaataatggtgaataaaccagtcacgaaatccagcatagctatctatatcccttactcccttataaatgttcccgcttaactcctcaaaatcctttatgacggcagcagattcctcaggctcaaggcctttatagccccaataaatttcttctccttgagtatgaagagccagcagtctgtcaggcggattctccgtgatcagccggtacatcgcaatagattccggctccgtaagcggagagattcccggaaaatcgcggtagctgggtgctgtcggttttcggtatttttcaatttcccataatgatggaaattgtttatttaaatcaaccccgtttatattcgccttccattcattaaaatttggacgatgttcatttagcctttcgagttcatctcttctggctcccatgacttctgatccgtttaaaacaagatcaacgccatccggattgacaagaggaacgagggataaggatgtgctgttaaacagctttatgggagaaaagccaaagaaaggcgaattgcagcataatgacatacagtattccttaaaccattttagcaggacagacgttgtaatccactcattcgcatgaaatgacgcgttcatatggaccttttttacggcatgctccccaccagccttcagctcccagataggcctgccgagtacagaacggccaatttcccggcatgagacaaacggaaaaacatcaataatcttctttatttccttttcaacagctgaatcatcatagattttctcttgctcaatccagctatctgaaagtttcagctgccgaggctgtaaaaagcgctttatgtcctgaatggtttgaagctctttgccgctatgctcctctatcacataaccagggcaatacaattgatgtttttgtgcggagcgatttgcacttttaagcaattcctcgtctatcttcagttctttcgccacattggccaaattgttcttgatctcaggtttcacagtaataaacgccatcatcatcccccttttttgttactatatgacagcgtatttaaaaaaagaaagcctcccgctcacttcaatgcgggagacattgtgattatgatgcctgatcaagcatttgtttttctttccgctttgacgaattgtccagccttttctggtcataaaatcgcaacaaatccccataaatgatttcatcagaaagtgatagctcctgttttgctttatcagcaaatgcttcacattgttttgtctcttctaacggttttcccgtctctttgtcataacacgcaccgtctgtataaacaacctgatctgtgataaagctcccgtcccggagcaccgtgaagtccagtttttcgtctgaaagcagatcgttgccgaattgaatttgatctttcgtatcaatccctaaaagattcatcagcgtcggcctgatatcaatctgcccgcctactgtttcaatggtttgcggctttttatcagtaatacccggaatatgaatgaccagcggcactttttggagctgtacctcttcaaatggggttatttcttttcctaaaaactgccccatcgcttcattatggttttctgatataccataatggtcaccatataatacaataacagagttgtcgtataacccgtcttccttcagcttttcgataaaccgtttcagcgcctcatcctgataacgcactgtcggaaaatatttatttagcgtctggctgcttgaatcatattcatcaatcaattggtcctcttcatcaagatcaaacgggaagtggttcgtcagtgtaatcagcctcgagtaaaacggctgaggcagatttttcatcagctctgaagactgctcaaaaaattctttatccttaagtccccagccgactgaattttcgtcagttacatcatacgagttaatatcaaaaaacgaatcatatccaaatgagtcgtacattaaatcacgattccaaaagctcttattattagcgtggagcaccgctgaatagtatccgctgtttttcaaaatttcaggagcggccatatattgattgcccgcattcgtaaaaaatacggcacctcgtccaagcggatacagtgaattgtccacgataaattcagaatccgaggttttcccctggcctgtttggtggtaaacattattaaagttgtagctctgttttataaagtcattcagaaaaggcgtgatttcttctccattcaatttttcattaatcacgaagctttgcgtcgactctaaggatacgagaatgacgttccttccttttgcagcgccgaataagcgtttgttggcatccttcacattagcggttacgtagttttcaatctccgtcaggctgttgctgtctgccaacgctctctgtgcggattgctttgactgaagaacgccatcgtaaatatgaaaattaaacaggctaatgtttttaacaagcatttctctgtcaaatgagcgtgtcaatagctgaggtctttccgcctcagacaagcccaggttgaagaaataaacagaagcaacgaacaaaaaataagccgcccgttcatttttcgttgagggaatgtccgattgaaaagctttttgccggatgtgaagccatattaaaaccgcaatatctacagctaataggaggtctgtcggctcaagaagtgttccgatgctgcttccgagatcacccatattgctcgtttgaaaaagaacagggattgttaagaaatcattgtaaaaacggtaaaaaaccatatttgccagcaatacaaacgtgacaagacagctcatcgcgataatgtagcgatttctgtttttgccttttaaaaacaggctgaggccaaaaataagcaacaaaaaactcaatgggttgataaacagaataaattcctgtgttagattgtcgattttaatatgaaaactggttttgtaaacagcatacgttttcagccacatcaataaaatggcaatcagcataaatgaaatcttcgaaaaaaacgtttttcgcatttcaacctcctatgcagcacgctcaaaaaaatcagtctattcccaacattctcattaacacatcaaattaaatcttaacctgagcacaacaaaaaatcaatttcatttacacaattttaacaattttgatgtttcagccattcatttttagcgatccaagcgcctccgataacgccggcatcatttccaagtgctgcgattgaaatatcagcagcttgggctgcccgcggaaacgcgcatttgcggaatgttttctcgacttttgatctcagcagttctccggctctcgatacgccgccgccaagaacgattttggatggattaagcgagcttgccaaatttccgagcaccaaaccaagatgcttggctacataatcaaccacctcaagggcaatttcatcattttcacccgccgcttcaaacacatcccgcgctgacaattgttcggttgcttttaaacgtgtcgtctttttagcatttgctattttttcttttgcaattcttacaattccggttgctgacgcaattgtttcgatacagcccgttttgccgcagttgcagggcgctccgccttcagggatgctgcaaatatggccgatttctccgccggcgccatttataccatgtacaatttcaccatttgcaatgatgccgccgccaactcctgtgccaagcgtcacgagaatgacgtcttttgcgccatcacccgctcccttccacatttccccgagcgcagcaatattcgcgtcattttctataacagctgggatgccggtttctgtctccagatggtttttcaaagcataatttttccaccctagatttactgtttcataaaccactcctgccgccatatctacagggcctggtgcacccattccgatgtatttgatgatgtgcttcggtttttgcagctcatccagcttgctgtcgattgtttttgcaattgtgacagtaatcgtgtcgccggttttatcagtcggaacttcccacttatgctgaatttcgccatattgattaataaaagcgagtttaatcgtcgttcctcccaggtcaatgcccgcaaaccatatctcgtccatttttatcaccttagcctttataaaaatctcttccgttttttgtttgttccaattcttttcgaaggacagctgccgctctggcccactgctccttttcaatcatgtggttcatgtataattcctttaattcatccagcataaactcaatttcaagctctctgtctccaaaataaacaatgtggccaaacgtttttaacagctgctgcacatcataaaatgtattcattttcctcaccatttcttgaacttaactatcataagcgtattcataaggaagcggtcagtcaagaagaaaacgctgacaaaaaagccagcttcctttccatattccacctctatgattctttattgttttcaatttgccgctgcagctccttgtagcgctgctccttcggcttcagtttcacagccgtctggatggccttttctgcttgtgcaagctcatttttttccgcatacaataacgctaaattgtaataggaagcatggtctttaggttcttttttcactgctcgttccaaaagggaaaccgcctgatcatattcgccgatttgaatatcagaaacagcaagaattttcaaaagatcggcagaggcatctttttgcgctgcttctccgttcagcaattctgttacttcttcatactttccttcctgatacagctcgcttgcctgctgaatcagcgctgactcctggtgtgaaggcgaatgcaatccgtaatataaaaatccaacagccaaagcaatcagcaaaaccgctgacaacaatctttttccaaaggctccggctttaggcaaccccagtgctgctgcagcgaaaaagccgccaatcaagccgccgatatgtcctgaattatcaatattcgaaaccgcaaaaccaaagcccagattgatgataataatgacaataatattggttcctatagttcttaaaaacatttttcgattagacaaagcaacatacagtaatgcacctaagcatccgaatatggctcctgatgcccctgccgaaggatacgggctgaacacaaaactcgcaatcgaacccgtaatgccagcagccagataaatcagcaaaaatctccccgatccatacatccgctcaaccgctgtaccaaccgaccataaagccagcgtattaaaagctaaatgcgctatgccgatgtgaagcacgatcggtgtcagaagccgccaccattctccttgtgcaatcaggctgttttcttttgctccaaaagccaccagtgtctccgtattagtgctgcctccgtttatttcgagcaagaaaaacatcaggatctgaagcgcaataaataaatatgtaaaagtcggttttccgttttgaaaaaccgccgcttcagtttttctctgttcttcttgtttcagcactagcgaaaggaagcgttctcgcgccatttgcgcgttttcaaacgaagcgtgttcctctgaacaatcttctgtacgaaatgatggaaaaaccgcttgaagatcatctcgaagcatcgttcctctaacgatcgccggctcaactgacacagttcccttctcaaaagttttttttgcaatctcttcccagtcatcaacaggggcttccgttgaaaaaaacacattcagcagcttcatccttcgtctgcccaattgatgtctgactcgttctactcgttcggcctgctcttcgatgtctctaaccatttcttgacggaaatcaagatcgtgcttataaagacgaactagatcatgagaggacttgtccggcgcttccagccatatttcatctgactcaccggcttgtatgacgccatacccgctattcaccaggtgcgccgcaattttccaatatgtatactccagcaaaaacatgtttaccgctccaatagtttttttttcattataacagctggcgctccgaaacgcctactgaaagcaaaaaatcccgtttttcacgggattttagaaagcttgctgtataaacttattgcggataaatggaattcttaaaaacaaatggataaaagaccgcctgattcctggctggctgagtacagtattcataagacggtagcgattttgataaaacatgacggcagaaaccgcgaaaatggcatatatcaaaagttttttcatgatatccctcctgccaatagggtttgttattctgccttatttattctcgaataagggacaggaaagttatgaaaaacaagaaataatccgatcctctgttatcagcttatgtaccgggatgtcatgcggcaaacggggtacgtgcgcaaacagctggcactccaaaagcaaagagactgtctccccttcatattcacttaaatagcgatcataatagccgcctccaaagccgaccctaaacccgttaacatcaaaacaaacacctggaacgatcaccaagtcaatttgtgatgggtttacttcttttgttttttcaattaccggctcgagcagtccggcgtaaacggtttcgagctgatcatcggtcttatatgtccgaaattgcattttcttcgtgtccggatggcattttgggatgcaaacttgtttcccttcttcccaagcctgctcaatgacaggacgcgtcggtatctctaatcctctggagatggtgaccgcaatggtgccggcattttgccactccggcagagaaaacaagtacttatacatacgttccgttttttgaagcagatcttcatttgataaagcagacagtgcctccagcgtcttttttcttaattgtgatttcatctctcatccccctcggaatagaaaaaaagccagaacctttttcaaagctctggcttttttcttacacctcaaacagcaaagctgttattttgtttcacggtgtaacgtagattttttatcacgtgggcaatattttttaaattcaacgcggtctggattgttgcgtttgttctttttagaaatatagttacgctcaccacattcagtgcaagccaaagtaatattaacgcgcattattttccctccaaactaaaatcatttacttattcagacttatatataataccactataatggacggaatgctaggctgtttttcaatgaattgctgaattattgaagatacgctcataaagctgcaaatatgatgacataatgagtcgggggtggtggagcttgaacacttgttgtctgccagcttcttttatccggcgggctttttcccggtcttttaaaaagctgtccagcagatcagccgcttcctgtacgagcgtaaaattagcgatgattgccgttttgtcatgaacggcataatcacaaaaaccacccgactgagaaacgacagtcagcacaccttgttccatgctttcttgcgcggcaagcccaaacggttcataagaactagggaaaacagccatttcacattgagacagtaacgttctgatgtctttcctattgagaaacggcaggaacatgacgcgatccttcaggttatatgccgcagctaatttctcatagcaggacagagacggcccctccccagccagcactagatagaggtctggctgacgctgcttcaagatggcaaacacctttaacagctgcgaaaatcctttttccggaacgaaccttccatatgaaaagagaaatcttctatttatgcttctttggattttccccttctcttcctccatagatgcagggcttgggataacggttatttttttatgtgctgccttattaagagaccgcttcataaatgtgcttaatacgatcaatgcatcagcggattctataaggagccgttcggtcttgagcctgtatgggtgtggggcttctcggcacaccttcttcctttctctttcaagaccgtggattgtcgcagtaagcggaaggccaagccgttgtttcaaatactgggcagcaggggcagttgtgtcatcatgggcatgaatcagatcaaagcgtttattgtgtgataacacatggcgaaccattgtaaagttagcatcagctatgtaatcttcaaacttcgcatacgaaaacagctgcccgctcggagtaaaaaccgtaatgttgatatgagggtttaaataggaaatgaggcggtttaaatggacacctagcccgcttttcggctcatcgggatgttcgggtgaaagcatgagaatgttcaccgttctctctcccctctcccataacaggtgtatgcagaaaattgctcctcccacctggtgtgcgcttcctcaatctgaaagctgtttatatgacgaatcccattttcatcaagatagatgtcgtctgtatcggcaagcttgagagagacattcattgaattcacaatactgtattcagcccgatatacagcatcaccagccgtctgtctaatcgtccattcgcctttatcatacgttgtgcgttttgtcctgacagcttcaatgtcttttcttttgatgacaatccgcaattcttttatcatatcctgcgttttttcgaaaaggacagcttcagccagccgcattgtttcttctgagatttcccagcttacggtcaaggtgtgagcgttttgaatgattatgtcgaatgtgtccctaaaaaaggaaagcttatgtcgtatattatagggaaatgggtgtttatccatggactcttaacattctcctttccaatcgttcacttcgtgttcctattaaaccattacataaagaagaagcaaagaaagatttctcgacaaaatctcgtttttttcgcgaattcctttagaaactattggttttatggtataaaaaagaaggataaaaaaagaatagaaggtgatgaaacgtggaaattgctattattgcgttgtttatcgtcagtatagcgctaattgcattctcatattctcaaagagacccgatgaaagatgtagaacaggagctcgaaacactgcagctttctgcgatgcaggaaatttacaagctcaaaaagaaaatgacagtgcttgaggaagaattactggaaacaaaccttgtcattcgcaaatcaaagcagaacgacatcaatcaaaaaatcgctaaacaaatactttctaaatataataacggtatgtcagctgaagcgattgctaaagctgagcatgtatcagtggaagacgtgaatacgattatcaaagataatgagaaggtgctcgtatgacaaaacggggcattcaggcatttgctggcggcatcattttagcgacagccgttcttgcagctgttttttatctgactgacgaagatcaggccgctgctgtaaaagataataaaacagtaactgaacaagacgtgaacaattaccttgattctaaaaaaatggtttctgtgaaccgtgatgaatatcaaaaacttcttgattcaaaagagaaatcgttgaccgatgacagcagctcagacacgaaaacagacaaagtcaaaacgtacaagctcaaaattaaagatggcatgagcactgcggatgtatctgctattcttgaaaaagagggcattatctcttcggctcaagactttaatgactatgtcattgatgccggctatcacaaagaaattcgtgccggcgagtttaaagtaaaatcagacatgagtttcaaaaagatcgtaaaaacgttaacacgataaaaaaacaggctgactcagcctgttttttttcatccaaactttcctgaaatgtaatcgagagttctttggtccttcgggttagagaacattttattcgtattgtcgcattcaacaagctcgcccatgtagaaaaaggcggtttgatcagaaacccttgctgcctgctgcatgttatgcgtgacaatgacaattgtgtatttatttttcagctctagaatgagttcttcaatttttctcgttgagattggatctagtgcagatgtcggttcatccatcagcaaaatatcaggattggtcgcaagtgctctggcgatgcaaagacgctgctgctggccccctgacagcgaaagagcggacgtatgcaatcgatccttcacctcatcccataacgccacgtcttttaatgacttttccacaatttcctgaagcttcttcttatttttggtgccgtggactctcggtccgtaagccacattatcaaaaatagattgcggaaacggattccctttttggaataccattccgatattttttcgcaaatccacgatgtccactttatcctttaaaatgttgctgccattatagttcagctcacctgcaagctttacattcggcgtcatttgaatcattaaattcaatgtcttgataaaggtcgatttcccgcatccggatggcccgataatcgccgtaacctcattttcataaatgctcaaattgatattttttaaagcatgatgctgtccataccataagttcattccattgacttgatagacttcctgtttcattacagcttcggtagcaatactcattgccgccctcctatccgaatttcccgttaatataatcctctgtcttttgctttttcggactcgtgaaaatctgttcggtctgtccgtattctacaagctcgccgtttaaaaagaatgccgtccggtcagaaacccgcagagcctgctgcatattgtgcgtgacaataataattgagtattctcttttcaatcctgtaattaattcctctattttcgcatttgaaatcggatcaagcgctgaagctggttcatcaagcagaagaacagccggcttcatcgcaagcgttctcgcgatgcataaacgctgctgctggccgccggataacgagagtgcggatgaatgtaaacgatccttcacctcatcccagagggccgcttttgttaaactttcttccacaatttcatctaaaacagctttattccgctctccggcatatttcaatgcatgtgtgatattcgcatagatcgatttcggaaatggatttggtttttgaaaaaccattccgatttctcttctcaagctgacaacgttaatattgccgcccaatatatttaatccttcataaaggatttcaccttccgctcttgcagatggaattaaatcgttcattcggttaatatttctcaaaaaagtagattttccgcatcccgacggcccaattaaagcagtcaccgcatttttttcaatatccatgtttacatgatgaacggcttgtttatttccgtaaaaaatggacagatctttgacctcaagcacgtggttctgcttcggaacaataacagctcgctcaggtttttcttttaccatttgttcagacatgcttttcgcctctttccgttctaatttgccgtaagctttttgtagatcatcgtgccaagccatctcgccgcgagattaaacacaagaacagaaatcaccagcacggcagaaccaccgttggcaatcgcttcagcatccggaatcattccttgtgtattgacgttccaaatgtggaccgcaagtgtttcagcgggcctgaaaatattaagcggtgatgtttccgaaaacgggttccactccgtaaaattaagacgcggtgttgtcaggcctgccgtaaataataatgcggccgcttccccgaacacccttcctgacgctaaaattgctcctgtgataatagaaggaatcgcacttggaattaaaaccgtttttacggtatgccagcgtgatacacctaaagcgagagaggcttccttcagatctttagggactgaacgtatcgcgtcttctgtcacacgcaccatgacaggaaggttaaaaacagttaacgcaagcgctccgcctatgatcgtatatccccagcctgttaagttgacaaacatcaataatccaaacattccaatgacaatagacggaagagatgaaagcacctctatacatgttctgatgaagtcagttactttgttattaggcgcgtattcagccatgaagaccccgccgcccacaccgagcgggattgtaatcagcattgtaataaacaaaatataaaaggagttaaacagctgatctcgtatgcctcctccagctgcaatggcgctcgactttgttgtaataaattgaaaactgagctgagaaacaccgtttataataatataggaaaacaaacctactaaaatggcagcgataatggctgcacacaaaccaaacattccggtcgccagtttatctgttattttgcggttcattacactttcctcctagatgacaagtagcgaataagcaggatgaacaagaatgacatcaccagaagcacaagccccattgaccacagcgtattgttttcaacacttccgtatgtggtgtggcccatattcagcgtgatgatcgttgtcagcgttcccgcagtgtcaaacaggctttccggcaatactcttgtatttccaatgaccatctgaacagccaaagcttcaccgaacgcccgagccatgcctaacacaacagctgtcatcaatgttggaaaagctgcaggcacaagtacttttctgatcgtctgccatcttgtggccccaagcgcgtaagaaccctctcgtaaactcttcggaagagaagccattgcatcagcagaaatcgatgtgatcgtcggcagaatcatgacggaaaggacaatcgttcccgccaataaactgtgccctgttccgctcgatttgaactgggcgataaacggcaccaatactgtaagacctatgaatccataaacaacagatggaataccgactaaaagctcaatcaccggctgcagcactttctttccccaattcggggcaatctctgtcatgaaaatcgcacctgcaatgccaagcggcgcagcgattagagcagaaagaatcgttactgcaaatgagccaaaaataaatggcagcactccgtatttcggatcagtatctgtaggattccaatttaagctcgttaagaattcaattgggcttacaccatttacaagaaaagattgcagccccttcacgccgaggaaaatggtgatcgcaacagatgccgcaatcataatcagggcacatgctgtcacaatcattcttccccgaacttcatccaattgccgattttgccttgagctgattaaacgctcgctcacagacatattttctctattgtttatcattgttttacactcctatgaatgtgttaagaggagaaacggttgtccccgcactcctctttttattaagatcagctttgcttccctttggcatcgcgtgtcactttcatatcagtaaccggaatgtagccttggtcagtaacaatgcttttttgaatgtcttcactctttagataatcaagaaattctttagctaaacctgtcgcttcaccttttgtataagaatgctgataagcccagatcggatactcgccagttgctacatttttcgcttcaggtttaacaccgtcaatagatagagcagttactttgtcatctgttaaatatgagaatgcaagatatccaatcgctcccggagtatcagcaatgatctttttcaccgtgttggaggaatcttcagtaatgccttctgcaggctccgctccgtcaagcgcatatttcacaaatgtagcacgtgtgccggaagaatcagggcggtttacaagtgtaatcttttggtctttgccgccgagctctttccagtttttgattttgccagtgaagatttttttcaattcatcttttgaaatatccttcacaccagcatcagggtttacagctgctgccataccaactacagcgacttgatgatcgacaagcgcttttgcatcgataccttctttttcttcagcaaaaacgtctgaattcccgatctgaacagctccttcagagacttgagaaagccctgttccagaaccgccagcttgtacctgtatatcagcatcagggttttcttccataaatttttccgcggctgcaagtactagtggctgcattgccgatgaaccagaaatggttaaagaacctgatgccttttcttctccttttgcagaatcgctattcgattttttactttctcctgcatttccgcatgcagctgcaatcatcataaaagcagccatcagaagcataagcaccaatttgttttttttcatttcctgaattccccctgcgtataatgtgtaatttgtcctacacgtatagagtaaaggttctatgtaaaaagggtttgaaccgaatgttaaggttttgtaaatcagtgcgtttttttgtataaaaaaaacgcccacatcatgtgagcgtttctttttagttatcagaagacgttgtgttttctgcattttcttcgattttgtttttattcttttgctgagtatcttctttgtcctgcttcgatttcagctcaaaatatttatccattacttccctgccgatttcgtttgtaatggtatatttagcgctgtaatcaatataagcccaagggactactacagagatcgcaatctcaggattatcagccggtgcataggcaacaagtgtcgtattataagtcgatgttcctgtttttgatttatcaggtccatcatagaacgattgtgctgttcctgttttaccggcaggctgatatgacgctgaagcaaattgactggcagctgtcccttttgtcatcacccgtctgaatccggcctgaacctctttaatatattcactcttcatgtcgattttattcagcacttccggctgaacggattgtacgacagcaccgatccctcttttagcatcaggttctctgacttcctttacaagctgaggctttaagcgatatccgccgtttgcaatcgttgatacgtattgcgcgagttccagcggtgtatacgtgtcgtattggccgatcgcatagtcaagcaagaatcccgtcaatctgtctgttcctttatagcctgtcatttcattcggaagatcaattccagttttgacacccagtccaaattggctgaagtaattacggaacgtatcaaaggccgtcgtatcaatcggtaaagcctggtgcggtttatattcaccttttccgagcgcgatcgcagttttaaacataaatacgttggaagactgctctaaggctctttgaatattgaccggtcctaagttagtccatgactttttaccgcgtttatcctgactgccgatatacaatggttcatcctgaaaaactgtattcagattgatagctccggtttgaaggcctgtcaagactgttgcgcctttgactgctgaacccatagcgtaagatgacgtcattgtacctaaagcgtaatcatcaattttatatttcccattttcttgtttaatctgcttgcccgccattgaaagcacttcaccgtttcttgggtccatcatgacaacgaatgcccggtctaacaattgcgtgcttggtcttgctttagcagatttgaggttcttctcaatgattttttccacttctttttgcaaatcaatgtcaatcgtaagcacgagatccttaccggctttgccttcagataccgtttttgttcccgtgacattgccgtttgaatctgtgatattttcgactttggctttttgtccctgcagaaggctttcatattggtattccaaatagctttttccgaccctgtcattacggctgtagccaagcgacagataatggtcgagcaagttggacggcaatccttcattagagctggaaacacttccgagcactgagcgaagaaggtttttatacggatattcacgttcccaatcggacgtgacatcaacacctggcagttcgtctaaatgttcacttaccactgccatttccttcgctgatacatcttcgtttttgatatattgaggggtcaatgcatagcccgaatccatctgtcttttgatagcgaggatctgcatatctttatccgtcaattcattcaactgcttatcagtaatccgttttagctgaagctggtataaatcgtcatcggatatttttttgtcttcaacctgctgtctttctttagagctaatgagctttttcgcttctttcggtctagtcaaaatccaataatcttttttatcccgttctgttactttttttgtatcgactttgatcatgtcagacagcttttttgcgatctttaagcgctgttcttgcgtggtcgatttagatctcgtgtatgtgattgcatttaaagccttatttgtcacaatggcattaaagtttcgatcataaattttcccgcgcggtaccgctgagctgacttcactttgttcttgcttattcgcttggtttttgtaatcatcaccttgcacgatctgcttgatgcccagttccacaataatccaggtaaatataacaaaggcagctaaaaataaaatattcagccggatcggaagcgacttctttttctctttatgattttgcttttttggtttatttctcctcataacatcaccttttctatttacagaaagaaaagacactcaagtaagagtgccagttttcattttaaaggttttttcgacttttttctacagataacccctttttggcaaaaaaattatctctcgccttttaacagggtcggttctgttacccgtttttggccgtcttcttccatggtttcattttccccttctttctccttaaaacggatatccttgacaaagtaataaatcaaaggatgtcctatacccaatatcgcaagtgacaaaggaattcccacatcctctttcagaagggccacaatcaggagaaagcacaaaatggaaacaattctgccggcgttcaagaacatttctctaagcacgatatattcaattcttgcttttctggcatgcctcgcgcgccctatcacatcatatgtaagtgatacatatggcacaagcaacagaggatagccgatggcaataaaaacgccatacgttaataatgtcgaaaagctcatatggaacagaatcaaaaacagcgcgccatacaaaataagtccgcccagcaaaatcgatttttttctcgcctttttcttaatcagcctggatgcaaagtagtaggcaaagaaggaaacagctgaattgacaagaccgaatgtaccgagagcaagttcgctgtttgtctcaataaatacaaacacactgattaaaaagacaaaaatcccttctctcaaaccctgaaaaaaatgcgcattcgtgattctccgccaattcatattgctatggcgctctccaaatactttgctcagcataaaacggccctttgattctctccgttttaagaaaaagctcatcacgacagccagggcaaataaactgagggagagactgaaaatcactgtataacccgtattattttcaagccttgagatcacgaatccggctacaatcgggccgatcattcctgcagaggaagacagaatgcccataaacccgttgaaaaagtctcgtgtatccggctctgttatttcaaaggtcagtacgttaaacgctagccaataaaagccatagccaactccgagcaccgcgccgattagcacgaggcggctggccgccgtttctccggctaaaagcacacttaaataaaaggcagctaaaaaaatgacgccgaaccttaaaatgaataccctgtctatttttttggctaaccgtccagccaaataaaaggttatcggctgcattgtcacaatggataaattatatatcgccaaatcaataaatttccctgactgcttccaaagatacacattaacaaatgtattggacagtgcaattcccagcgagtaaagcccgccaatggtcagcagaaagagtaaccctttgtttacgtctacatcgcctatcactttttttagtttgctcattactgactcccctttactatcccttagtctgtctcactcaaaccgagatatgtaaaaagaagacataaaaaaacaaggtcccataatgaggaccttgtttgtgccattattttgcttcgctgtatagacgagccacttcgtcccagtttacaacattccagaaagctgaaatgtaatcaggacggcggttttgatagttaaggtagtaagcatgctcccaaacgtcaagacctaagataggcgttttgccttctgaaagcggagaatcttggtttggcgtgcttgtgatttcaagtttaccgttgttcacaacaagccatgcccagccagaaccgaagcgtccagctgctgctgctgcgaattgctctttgaatttgtcaaagcttccaaatacactgttaatctcttcagcaagcgcgccagtcggttcgcctccgccgtttggagataaaagtgtccagaataatttgtggttcgcgtgtccgccgccgttgttgcggactgcagtgcggatgttttcaggaacagaatcaagatctgcaacaagctcttcaactgatttgttggcaagagcagtgtttccttcaaccgctttgtttaaatttgtcacgtatgtgttgtggtgtttcgtatggtgaatagtcatagtttccttgtcgatatgcggttctaaagcatcgtacgcataaggtaattctggaagttcgtaagccatgataattcctccttagtatatatgtactgaaatgccgcttcacagcgagcctttcttcattcaatgtaacaaaagaatgctttgtaatcaatgaaaaagctcacgatttggctcatttcagcggacatatttcactttaaccgataatctgccccattaaacctgccgccagcatttcttataggaccgtccataaaaagtatccgatcatcaaaagctgtatgatgccctttgcaataacccctgttaaaaaaccaatgagtgagccgaggccaattttaaacgctgactttaagtccttctgatgaacgataagttctgcgcaaacagccccgataaacggccccaatatgatccctgcaaccggaatgacaaaaggcccgattaataaaccgatcgtgcttccccatatggcagctttgcttcctccgaacctttttactccaagcagattcgacacgtaatctgctgcgaataatactgcggcaaaaactgcctcaacaagccagaacatataagaatacggactgaatgaaaataaaaatccgtacaatacaaatccggcaacaataaatactacgctcggaataacaggatacaccagcccgataaaggcaatgataaaaaccgctgcaatcaacagccaatacaacatatccatagcttccatcctcccattttactctgtcttcttcatgtcttccttgtattcacacgcatgcaacgatacaataagcaacatatattagtttagctaggaagtgaagatagtgaatgtgtttcagcttttcattaaaagtacatactctccccgtgatattgcaaaaacaagatttcaaggaatcggaaaagcgattctttatgtatttttgctctctgtcctgtttgcaatccctaccgcttattatgtaagtacagggaccgtaaaatcaatgaacggctttaaaactgttttaaacaaagatttccctgatttcacaatttcaaacggcaaacttcaaacggatgagaaaaaagccacggaatctcaagcaaatggtttcgttatcgtgttcgatccgacagactcctatggcactgaacaaattgaagcaaagcaaaacgcgatcggcatccttcagaacaaatttgttttggccattgacggacaagcccaagaaatgtcttactcaatgatgccatcagagttacagaaaaaagatgtcattgcagggttaaaccaaaataaagcgatgattgtaactgttctctcagctcttatttttctcgtaacagcagcgggaaaatttattgaagtatcgtttttagcgcttatcgggttaatcattaagaattcgcagaaaaaacatttatcctatcatcagctctggaagctttctgcttattccatcaccctttcaactgtattctttacaatcatgcgggcattagaagcaaccgtaccaagtgaatttttgctgaactggtttgtcaattttgtcatcctgtttctcgttttaaaagagattccgtccaaaaaagctgctgtataaaccgaggctgcattcgcagtctcttttcttttgtcatgaatcgaaatggacaagcatactatggtataaaatttcgtatgcgggaggaaaagcgatgaagcgtctcaccttagtatgcagcattgtttttatactttttattcttttttatgaccttaaaattggaaccatacccattcaggacctccctgtctatgaagcatcagcaaaaacggctgtacaagaaccggcttataaaacggtgaaggtaaagccgggtgatacggttatgtcgatagtcggatcagcaggttctccggatgacattgtaaaggattttgaagcactgaatccaaaagtgaaagctaacgccattcaagcgggaacagcgtataaattcccggtctatccttaatttaacgttaatttcttgtcagttcggcgaagacactgttacaatgtaatttgtaaaataaattcacataaaccatactagaattgttatatctagaagcggcaactacaattaaggagcgattgcaagtgagtgaaatcacacatcgtacaaaaacgcgtcccgtcaaagtgggacctttaacaataggcggcaacaatgaagttgtcatccaaagcatgacaacaacgaaaacacatgatgtagaagcaacggttgcggaaattaaccgtttggctgaagccggatgccaaatcgttcgggtagcatgtccggatgaacgggcagcaaacgccattgcggatattaaaaagcgcatttccattcctctcgttgttgacatacatttcgattataaacttgcgttgaaagccattgaaggcggcgcagataaaatccgaatcaaccccggcaacatcggccggcgcgaaaaagttgaagcggttgttaaagctgccaaagacaaaggcattccgatcagaatcggagtaaacgccggttcattggaaaaacgcattttagaaaaatacggttatccgactgccgatggaatggtagaaagcgcacttcatcacattaaaattcttgaggatcttgattttcacgatattattgtcagcatgaaggcctctgacgtgaaccttgcaatcgaggcttatgaaaaagcggcgaaagcgtttgactacccgcttcacctcgggatcaccgagtcaggaacgctgtttgccggcacagtaaagagcgcagcaggactcggcgccattttaagcaaaggcattgggaacaccatgcgcatttcactaagcgcagatcctgtagaagaggtaaaagtagcaagggagcttctgaaatctttcggcttagcctccaatgctgccacgctcatctcatgtccgacttgcggccgtattgagattgatctaatcagcattgccaatgaagtggaagagtatatttctaagataaaagcgccgattaaagttgctgttctcggctgcgctgtaaacggacctggtgaagcgagagaagctgatatcggaatcgccggcgcacgcggtgaaggactgctgttccggaaagggaaaattgtccgtaaggttccagaggaaacgatggtagaagaactcaaaaaagaaattgacattcttgctgaggaacactacgcaaaacttgaagctgaaaaagcaaaattaaaagaagaaacacaaaaagcttgacgggaacccgtcaagcttttttgtgttagaaaaatggaataataaatattccaagcactaatgaaacgacaccgatacccattgcccaggctccaaggccttgagcacctcttcttcttgcgatatagccgacaataataccggcagctcccaataaaacaggcagtacaaacaatgaaataatggacaaggctaaagcgatatatcctattccccgtccttcattgacattgccgccgctgcgatcattgtcttggtcattgctgcggtcagcagcacgataaggctctgcgatttcagcagctgtttcctcaaaaaaaccgtcattgtcgcgggtaatatttgtcccttcagatccatgatcaacatagtaactgttgttatcacgcttttcgtaatcgtttgccaccttcaattcccccttctgttttattaaaggagcttttatagtttgatccattttgcctgattcatgtttgctaaacttttctgttaatgtcaattgtttatgttacacttgaagggatgaaactgaaggagtgtgggcatgttacgcttaggaatagatattgacggcacaatcacggctcaggatacattcgtcccttatttgaaccgttcgtttaatctttccatttcattaaacgatatgacggattatgatttaacaaagctgttaaacattacccaggaagaattttgggattggatgaatcaaaatgaagcgatcatatataaggaagcattgcttgcacagcatgcgaaacagtcacttgattttctcaaagaggagcacaagcttatttatattacagcgagacggactcatttaactgatattacctatgaatggtttgacagacaaaacattcattatgaccacatcgaactcgttggcggtcatcacaaagttgaagcggtcaagaatcataacatcgacctgttttttgaggatcatcacgggaacgccatgatgattgcgaaagaagccgggataccggtgattttgttcaattccccttataatcagcttccgattgattcaaacatcatcagagtaaacaactggctagaagccgttcaatggatgaacaacaataagcatcacttaatacgtgtcaataactgaaaaaggagcccaaaccgggcccctttttcatatatacgcattttacgcagtagtgttttcttggttttccgctgtacaatcagggcatgtgccataaatctcaaatttatgcccgctgacctgatagccatccaaatcatcacaaagcttgtccatcggacatgattcaatttcctttgttttgccgcaggcaagacaaataaaatgatggtggtgatgggtgaatgaacacttaaatcggaagagcttttcaccggacagctcagttgtttccaaaatcccaagttcttcatataaagaaagatttctgtagattgtatcaaagcttaagcctggataatcatcattcagtgcagacagtacgtttttagcggtaagatatctgtctgaatcagcaaaaagctgcagcatatcctcccgtttgtttgtatatttatatccgttttcttttaataggttcagcgcttcttggacgttcatgaagggtcccccttttcgctttgcttaagaacgtatcacatgtatgaaaaagaaaatggcagctgtctgtccagcaagccattttctttactgcagataaaattatacccataaaatgaataaaagtaaatgaaagcctagtggattgcgtttttgaattttccgcctctcgtttcatgagtattcataattgttatgaatgcattttgatcaacttcaaacacgatcgatttgagctttgtcacttccagccttgtgacaaccgcgtaaattacgtctttttcttcgtccgtatatccgcctttccccttcagcttcgttgtgccccgaccgagacggtgcaaaatcgcgtcggaaatctcatcatactgctcagacacaataatgacagcttttgtttcatcaagcccttggatcacggcatcaatcgttttcatcgcaatataataagtcatgaatgagtacatcgcttgctcaggaccgaacacaaaaactgcccaaatgaaaatgaacacattgatgaacataacgaactcacctactgaaaacgggagttttttggtcagcaaaataccgagaatttctgtaccatccattgaacctccgtttcgaataacaagcccgacgccaaagccgagtaaaagacctccgaacacagtagccaaaataggctgggttgtaatggcttctacatggtgaagtgaggattcaataacggcaagcccgacaatccctataaacgtagagactagaaaggtcttaccgatatatttatatccgaagatcataaaaggaatatttaatatgacaacgaaaaaagcgaaattgagaaaggggtttgacataaagaggtggtctaaaataagtgatacaccgataatcccgccatcaataaaatcattggggattaaaaataattcaatacttacagccgcagatgcagctcctaccagaatcataaagaccctgaaaataaaatgggtaaatgtttctttcttatgttgttttgttggggtcataaaatctcctttcctgcaataactattttaaatacattataaatctattttaccattaaacactgacacattttactgatttgcccatacattaagtctggaggtggaatgaccaatgattttatttcaaagaattattttacagcggcttaatcaggctactgctgatgatttgctgaagtactcaaaacaatacggaatcagcttaacaagatcgcaggccgttgaagtagcgaacttgttatacgggaaaaatgtaaacatctttaatgagagtgaacgaatgcggctgttgaaacaagtagagacgattacatcgaaagaaacagctcaaacagttaatgaactattcaaacaatttacaagctaaaaaatgggggtgttatcccccattttttattgctgtaaaatcttttcgagcaatgtatcatcaaattgtttttctttcagcatgtcaatctcaaaacggtatggcggttttttgttctttttatcttcaccgacatatggtgtttcaagaatttttggaatgtcttttaactgctcatggtgaacaacatattgcagtgcgtcaaaacctatttcaccaaagccaatattttcatggcggtcttttctcgcacctttgacatttttgctgtcattgatatgaagcactttaatacggtcaatgccaatgactttatcgaactcattcagcactccgtcaaagtcttcgacaatgttatacccggcatcatgtgtatggcacgtgtcaaagcacactgacagctgctcattgtgtgtaacgccttcgataatctgtgcaagctcctcaaagcttctgccgcattctgatccttttccagccattgtttctaatgcaatctggacattttgattcggatcaatcacttcatttaagccttcaataatttttttgatgccggcttcagctcctgcccctacgtgagcgccaggatgaaggacaatttgcttcgctccgatggccgctgtccgttcaatttctgaacgaagaaaatcaacacccagctcaaaagtggacggatttgtcgtgttgccaatattaataatataaggcgcgtgtacgataatctcgtcaatgccgttttcttgcatatgtgcccggcctgcttctatatttaagtcttcaattttctttcggcgtgtattttgcggtgcgcctgtataaatcataaacgtattcgccccataagagactgcttcctggcttgctgccagaagcatatgttttccgctcatagagacgtgtgagcctattctcagcaacaggttcccctactttcttttcttagattggtttcttctctgttttttcttgattttctccatctcatagctcattttctttttatacccaggcttaaccttcttcggctttttcacgagacgatgagcaatttcatccgcttcattcggcgtttttttacgctttttgcggcgctgacggtcatcgccttttttccattcgcccttttcaagctctaagtaatcaaattcgatgcccattttttcaagtcttactaatgcatcctcatcagtaagctcataaatggtcatcgcttgtcctgatgagccggcacgagccgttctgcccacacggtgaacatagaaatcgagatcatccggcagctcatagttgataacatggctgacacctttaatatcaatacctcttgcggcaaggtcagttgcaatgatatatgtgaattccaaatcattgatctgcttcatgacttttttccgctcacgtggtgttaatccgccgtgcagcaagccgattttcatgcctttgccagtcagatactgggcaatatggtcagccgtatttttcgtgttggcaaacacaatccccaggtatggattcagatgcgacatgatgtcaaaaaggagcttgtccttgtcacgatgtttcgaaggaatgaggatatgctcgattttcgcagcagtcacctgttttggctccacatgggcgtatttcggattttccatgtatttcttcaagaatggtttcagcttttccggtatggtcgctgagaacacaagcatttgcagatcctcaggcatgcgggaaccgatgtaatctacatctgcaagaaatcccatgtccagcattaaatccgcttcatcaataacaagagattccgctttatgaacacttaacgcctgttctttgattaagtcagcaatccgtccgggtgtaccgacaacaagatgcggctgtattttcaatttatcaattgatttttgtttatcagtgcctccgataaaacatttcgagcgaatctgactgccttcctcaccctgcgtgattttaagcgcttcctgataaatctggttggctagctctcttgtcggagccgtaatgactacctgaacgacatccttagcaggatcgattttgtttaataaaggcagtaaataagcgtgagtctttccagtacccgtctgagactggccgatgacgctttctttttttaacactgcaggaatcagccttttctggatatcagtcggttcgtaaaaaccaaggcgatgtactgcatctataataaatggtttcaattcataaagttcaaatttcgtttctttcatttttcccagctccttaaagcggcacattatgtgtccatcatcacattatacccgattttgcttaaaaacaccacgtttgcaaggcgtttgttttattcagttatgtaaagcaaataccgcagcccatgcatattctaatagcagagagagctgaaaggaggtacaagtatgttttcaccgcagcagccaatgagaaattacccacagcccggaccgccccgccccatgccaaatcagcgaatgatgggcagaagaccgcctaatatgcgaggactttcatttggagcacagcagcaaggttttcagcaagccggacaatttcttcctcaggcaaatgccggagcgagaaatggtgcaggtgcaggcggaggcttaaaaggaatgctgtcaaggttcctacccggcggaggaggcgctggcagtgccggagttccaggagttccaggagcaggtgccgcagcgagcggaggtgctggcctgcaaggcattcaaaatatcgccaatcctgcatcattatccagtatgcttggaaatgtgcaaaaagtactcggcatggcgcagcaagtcacccctatgatccagcagtacggcccattagtccgcaatctgccagcaatgatgaagctgtacagccaattaagtaaaagtgatgatactgagacagaggccaatgaggaaagtgaaaaacaatccgtttcagaagaatcatcagaaaaagaaaaagagactgaaacaaaaacctcagatgggaacaaaaaatcaaaaccaaaaagttcttctctcccaaaaaaatctaaaacaactgacaataaagaacaagaatcaaaaacatctgcctcgaagaaaaaggaagctgcctctcctgctccgaaaagaacatcaggcagttcaaaaccgagattatatatttaacattctttgatatctgaagtgagattggctataatgagatcagaagaatgcaagaatagagccgtttgattacggctttttatattgcctttactcacttcagtattggaggacaaccgaaaatggacgtaattaaaatttcaccgcgcggctattgctatggtgttgttgatgctatggtcattgccaaaaatgcgtcactagataaaagcttgccaagacccatctatatactcgggatgattgttcataataaacacgtcactgatgcgtttgaagaggaagggatttttacattggacggctctaaccgtctggacatcttaaagcaggttgacaaaggaactgtcattttcactgcgcacggtgtttctcccgaagtcagaagaatcgcagaagaaaaagggttagtcgcaattgatgctacatgtccggatgtgacgaaaactcataatctaatcttagagatgaaagaaaaaggatatcacgtaatctatatcggcaaaaaagggcatccagagcctgagggagccgttggcgtagcgccggagatcgttcacttagttgaaacagaagaagatgtaaagaaccttgatatccaagcagagaagttaatcgtgacgaatcaaacaacaatgtctcaatgggatgtccacgacattatggagcttgtcaaagaaaaatatcctcatgtcgaatatcaccaagagatttgcctcgctactcaagtgcggcaggaagctgtatcagagcaggcaaaaaaagcggacttaacaatcgttgtcggagacccgaaaagcaacaattcaaataggcttgctcaagtgtcagaggaaatagccgggacaaaagcataccggatcggcgacttaagcgaattgaagctcgaatggctgaaaggcgttaataccgttgcagttacagcgggagcttccacaccgacgccgatcacaaaagaagtcattcgctttttagaacagtttgatcacgaagatccatcaacttggacaactgaacataatataccgctcaaaaaaatacttccaaaagtaaaagcaaaaaactgaggctgtaaaagcctcagtttttttatagaaatgtaaatggatttgtatctgtttcagaaacaaagatattcacgtcaaactttttatcattacacattgatgtcagctttctcgtgacgccttctttcatgattttttccgcatagtgtcccggatcaaccacatttaggccaagcatcatggcatcatgggccacatggaagtataaatcccctgtgacgtaaacatcggctccctttcgttttgcatgatgaatatacttgtttccatctcccccaagaacagctacctttttcaccatgctgtcagcatcccccaccattctgacaccattgacgtcaagcttgtctttcacaaataaagcgaattccttgagcgtcatctcatttttaagggttccgacacggccgagtcctttttcggcaggagtctgttcaacaggatagatatcgtaagcaacttcttcatatggatggctttttatcattgcattgataacagctttttcgacgcttttaggaaatacagtctcaagccttacttcatgaacaagctcaagctctcccacttcaccgataaaaggcttagctccgtctaatggtttaaaactgccgattccttcagatgaaaacgcgcaatggctgtattcaccgatatggccagcccccgcatttccgagcgcggctctgacctgctcttcatattccttcggcacgtatactgccagctttttcagaggatccgtataagtaggcaccagcacttccgtctcactcagctctaatgcttcagcaagcaaatcattcacaccgccgtccgcaacgtctaaatttgtatgagctgcataaacagcaatatcatgcttcaaacacttttcaattaaccttccggcaggctgatctgttgaaatatgctttagcggccggaaaattggtggatggtgtgcaataatcaagtcaacctctttttcaatcgcttcatcgataacgctctctaacacatcaagtgtaaccatcacatttttaattggtttgtttaaggtgccgatttgcaggccgattttatctccttcaaccgcataggctttcggggaaaattgttcaaacagctggatgatctgctgcccatttacacttttagccatgatcgattacctcctttaacagctccattcgatcggcgagctcctttaatttttgtttgttttgctctgtatccgccgcttggctgatctgttcataaatgctttgagtgtgctgaagctcttgtgtccactttttcaaaaagacagcatttttttcttttgccaagaaagggccaacgagcatcccggctgataaagaaataccgtcataagccgcatccctgtctcccgcttctgccaccagcacctcatagcactttccgtcctcttcaaggattacctcatctatcagcgcatatctttctttataaagccactccctgatatgaacagcatgaatattcggctgtaaaatgagccgttccttccccgttaatttgtctttgcccgcttctaaaatatgagcgatcaaagatccgcccattccggcaatcgtaatggcatcagcttcaccttttttaatcacttccagtccgtctccctgccttacagaaatgtgcgagtttaagcctgatttttcaacctgccgctttgcagacaaaaatgggccgtctgttatttctccggcaatcgccccgctggctttatgattcagcaccgcaaaacaaggaaggtaggcgtggtcagagccgatatcggccatcaccgctccattcggtatgtactccgctactgtttgcaatcgtttagataattttaattcgttcacttgtcatcacaacttttctcaatcattttttcctttactatcatataaaaaatcagcccggaatccaagctgaagcaaatgattttgaaattatttcttttgatgggggtctgcacgcggcagtcaaaaataaaaggctgtcgagaacatctcggcggcctgtgaatgtataaagagaaaaatggttcttttatttaatttttgacacccactctgccatatcatccagcttatcggccggtacaagaccggaaggcattccattaccgcctttttcgatctttgttttaatttcagcgacatctttcttatcccctacaccttttaagctaggacccgaaacaccttcataattttcaccgtggcatgcgatgcagtttgccttgtaaatttcttctggtgaagcgtttgcatctttcttttcagcagatttgctttctcctccgcttgcaatctcccgagagtcatcaagtccttttactgataaaaagaaagttagaccaattcctaaaacagcgatcagcaaaaatggaataagcgggttccatttcatttcccttccccctttttgatccttccccctatgtaaacacttctaattctaacttatttttacaaaaagtaaatggattgctatacaaaagttttttattcacactttatacaaaattgaattgaaacatgcctaaatctctaatatcctttttattctattgtataatgtattgtatacgcttacaatagaaaatatggaattagattttgaaatttttcaccacaatgttcatttgcaaatgacatcatttttcagtaaaataaaggcatattatccatatatctttttaaaaaaaagaagaacggatcttcaagacccgttccatcttattcaaggaaatctttcaaacgtttacttctgctaggatgtcttagtttccgcaacgctttggcttcgatttgtcgaatacgctctctcgttactccaaatactttgccgacctcttctaatgttcttgtacggccgtcatcaagaccgaatcgaagacgcaatacattttcttcacgatcagttaacgtatcaagcacatcttccagctgctctttcaatagctcgtatgcggcgtggtcagaaggtgaagttgcttcttggtcttcaatgaaatcaccaaggtgcgagtcatcctcttcaccgatcggtgtttccagagataccggctcttgagcaatctttaagatttcgcgtactttttcaggcgttaaatccatatcttccgcaatttcttcaggtgttggttctctgcctaagtcttgcagtaattgacgctgcacacggattaatttattaatggtttcaaccatatgaacgggaatccggatcgttctcgcctgatcggcaatggcgcgtgtaatcgcctgtctgatccaccacgtagcatacgtactgaatttataacctttgcgataatcaaatttttcaacggctttcatcaggcccatgtttccttcctggatcagatcaaggaacagcataccgcgtccgacataccgttttgcgatactgacaacaagccgcaggttcgcttcagccaatctgcgtttagattcttcgtcaccttcttcaatcttttgagcgtaggcgatttcttcttttgcagaaagaaggttaacccgaccgatttcctttaaatacatacgaactgggtcattgattttaacgccaggcggtacacttaggtcattaaggtcaaattcttcttcggctttggcaagctgctgaatattaggatcttctgtttcttcattctcactaattaattcaacaccttgttcacctaaaaattcataatactcatccatttggtctgattcaatttcaaagctggacatacgctcagcaatttcttcatatgtcaaaacgccacgttttttaccagactctgttaattgctcttttacttggtcgaatgttaattctgtctcgtgggtttgtttatcagccattatggatccctccttccaaagcttgcaacgaattctataagcggtatgattcttattcggtccattcaggcgttttctatgtgaactgcctttaacaatgtgcgaataatgaaatgacaattcatgatgaggttaagcgatctatttgctcctccgcaaggaatcattgccaataaatgctcctcatcagttctccagttattttaaagatcggttcaatgtaacgatttcttgagccagagaagcagctcttaaaaaatctttttgcctttcggcttcggctctttccgcctctttttcttttatcattgaccaatttctttgattcaacactttttttacataatctgataactcggcttcgctaagctcttgattaacctgaagcattaatatatcggacaagagctggcttatatgatcatccgtcaccctggccatcagatgctgaggcgtcagctcggctccctcttcataaaaagcataaagataagcggctaatgcccggtgctcatcaatattaaattgaaaccctacccggtcaatcacttttttgatgacgctccgatctcgaagcatgtgagcgagtaacagcctttctgcattttcatacgccggacgcaaacgtttttgccttgcttttgtcgtcagatgcgctcgccgcgtttttgtttcaccgctattgtcagcaggtttgttttgcttgctgaaaacagacagctgctcagttaaagactcctgtgaaagcgaaaactctgaagcaagctgctttacatagacttcctgctctagagaccctgaaagcgtgctgatttctttcagtacgtctttaatgtaagctaggcggtcgccttcatcggacaggttctttccttttcggaaatattgcattttgaacgccattacggtgacacttgcgtcaataatgtcgtttttaaatttttccccgccgaattttttgatgtaatcatcagggtccaatccgtcaggaatcattgcaactctgactttgcagccttttttttgcagaagctccgaagcttttaaggtggcttcataaccggctttatcagagtcatagcaaagaatgatttcttcgacgtttcttctcaggatcttgacatgatcatctgtaagagacgttcccatcgtggctatgctttcctttacacccgagcttacggccgatatgacatcagcaaacccttcaaataagactgctctttcctgctttctgatatgaaggcgggccttataaaaattgtaaagcagtttgcttttatgaaagagcggggtttcaggactgttcatatacttaggctgctggctgccaagagccctgcctgagaaagcaacaacagccccgtgatgatcatggatcggaaacatgacacggtttctgaagcggtcgaaatatccgcttccgtcttcgcgtctgatcaggagacccgctttttccatttgcgcctcactaaatcccctctttacaaggaatttcgtgataaagtcccaagaatcaagagcatagccaatctgaaattcattaatcagctctttcgtaaagcccctagaaagcagataatccagtgcctcttgaccttcttttgtatttattaacaaatgatggtaaaatttcttcaggagctcatgtgcctcagccattttttgttctccagaagactctggccgggctccggaatggactgttatatcatctggaaaatcaatttggtatttgtcagcaaggtgagaaaccgactcggcaaaagaatagccttccatctgccttaaaaaagagaaaacattgccgcccgctccgcagccaaagcaatgaaaaatctgtttgtcgggcgatacggaaaacgaaggtgtgctttctccatgaaaaggacagagtccaaagtagtttcggccttgcttctttaattgaacataatcacctatgacttcaacgatatctgccgacttttgcacctgatccacaatttcatctggtatccgatttcccatcttataacactccgtcgtacattattcgatgctttagtgcaaaatcccttcatcgttcgacaggattttttgcagcagtgtaataaatcgttctcgatcttctttattcaattttttaggccctttggcatatacgccttttcttctttgtttgccggaaaaatgacggccctctagggcaaaatcaatcgtgtcttccttgtaaagacgacctctttccgacataacagagacatttctgttcaacagcagagatgctaatccgatgtcctgcgtcacaacaatatctcccggtttcacgtgatttgcgatatataaatcagcagcttctttatgaggatcaacatacttccatttttcttcattgcttctggaaagctgataatgttcaaatgaagcgacaaaaagaacttgaacttcatactcggatgctgtttgtaaaatttcatcttttaccggacaagcatcagcatcgacaaaaatcgtcttttcttgttcattaagaagagtaattctccatccctccattaaactcctgcataaaagcaagcaaaatcgcacatcctttattattgtggatgtatatgaatttgtcgaaaaatttccgggagaaattcttgacatcttacccataatagtttattcgtatcacacgatccttaaacctaaaattaatcattttatcacaattttttattataatacaaacttcacaaagatgctattgtttttcattattcccttttggcacagccaaaaacccaggatagagcgtcctgagttatatgttttttgttttgagatgatggataatatttgctgtttcctcaaccgctttatttgaaacatcaacaacctggcagccgatccgatccacaatcttttcgaaatactcgagttcctctttgattctgttgatatttgcataaatcgctttatcattaagcccgagtgattttaaacgttcttttctgatatgattcagtttatcagggctaatctttaaaccgatgcattttttcggatcaacgttaaagagttcttccggcggatcaacctccggtacaatcggaacattggcaaccttcaggcgtttgtgtgcgagatattgagacagcggtgttttagacgttcttgacacgccgatcaaaacgatatcagcttttaaaatccctcttggatcacgtccatcatcgtatttaactgcaaactcgatggcctccacttttttgaaataatcttcatcaagctggcgcacccgccccggttcgtatttcgctgttaaaccgtaggctgtttccattttatcaatcaacgggccgataatatcataatataaaacatttgctttttccgcttcggctatcaaatattctctgatttccggcaccacgagtgtaaaacagataatgccgcagtctgcctttgcaagtgaaatcacttcattgatagtgcctatatcttcaacataaggaattcttcttacatgagtatcatccgccgatccgttaaattggctgagtgctgcttttactaccaattcagccgtttcaccgacggaatccgatacaacatagatgatgcggttattcatattatccccccgttagtttgcaatcttataggatttcattttcagataaactgacaagtattttggtcatatttgtttttgtcactctgccgatcacttcaaagcctttatcggtgtctttgatgacaggcagtgcatcaatttgtttttctattaagtgctttgcaatgtccatcacataatcctcgcgtctgcacaccgtaatgttcggcatccttgtcatgatgatgtgaacagggaccgatgtaagctcctgctggccaatgctcgctctgagcaagtcttttcgtgaaagcaccccgactaaaacagcatcgcggtccaccacaaacagagtacctacatcttctaaaaacatggtgcaaatcgcatcgtacacagaaacgttttcgtgaatcactacggggatagattgaaagtctttcacctgaagctttttgagtttatccgccaaaagctgtgtgccggtttttcccgtatagaaataaccgactctcgggcgcgcctcgaggaatcctgacatggtgagtatggctaaatccgggcgcaatgtcgccctggttaggttcagcttttctgcaatatgctcccctgtaatcggcccgttttcttttacaatctgcaaaatatgttcttgccgtttatttagttcgatcgtactcaccaccttttcacttcatagctatgtaaagaaataataatccatattataacgtaaatatcttgtaatcaaacaaaaaacttataaatggggaaaagacgattaccgatcacacagcaaccgccttttctctctttattttacaataagggcattcatattcgcaaaggacttgatctcatccgccaagcttaccatttgcgctaaacgatttgcctttaatgactcattatccgctataaccattgtatgatcgaagtaagcatcgatcggttcttttaaggctgcaagtgaagcaagcgccgcctcataatcttttttgctgaagttttcctgcagattttgcttcgctgtttggtaggcatcaaacagttttgcttcgtattcattttcaaacagatcaggctgaatgtctccgcggactccttttttgctgatagagatcactcggcctaacgcttcggctgtttccttaaagccaggtgcaccaagcttttgctccagtacttgtgctttatgcagcgcagagtacggctcaagctcagagctttccagcacggcgtcaatgacatcatgtctgatttgttcagcattcaagacatatttcaagcgctgagtgaagaaatccagcagttcattttctttatcggtttgaacgaaagtaagcagctcttcaaatgaaattccccagttgcggtcaagaagaatcgcaacaataccgcttgcttggcggcgcagtccgtaagggtcctgggaaccggtcggaattacgccgatagagaagaatgaagcgattgtgtcaagcttatccgccattgctacaacagctccggtgaaagtagaaggcgtttctccgcccgctgatctaggcatataatgttcattaactgccgcagccacagcttcatcttcgccaagcattctcgcatacttttcgcccataattccttgaagttcagggaattcatatatcatatgcgtcacaaggtcgaatttagaaatttcagcagcccgcttcacatgttttaatgtatcttcatcagcctgaagacgaacggcaagtttctctgcgattgatgtgactctcctaaccttatcagcaagagaaccaagctcttcatggaaaacgatattttcaagtttcttcacatttgcatcaatgtttagtttctgatcttccttgtagaagaatgaagcatcagataaacgtgcgcgcagcactttttcattgcctcgggccacattttcaatcgcgtggctgttgccgtttcggactgtgataaagtgaggcagcaggtcaccgtttttgtctttgacagggaagtagcgctgatgctctttcattgttgtgacaagcacttcttcaggaattgacagaaactcggattcaaatgaaccgtaaagagctgtcgggtattctactaaatgattcacttcatcaagaaggtcttcgtcaactggaatgctccaattgttttcagcagccattgtttccagctgagattgaatcatttgctttcggacgctaggatcagcaataacatgctgttctttcagctgctcttcataagctgaaggtgattcaattgacgcttcatgtccgaggaaacggtgtccctgtgttgtccgtccagactcaacgtttgtgatcgaaaatggaatgacatcctgtccaaataatgcgacaatccatttgatcggtcggatataacgcaaatcttcatttccccagcgcatgtttttcgggaaatgcaagcttgtaattaaaccgctcaattctggcagaagcgacttcgtttcttggccggcttggaatttttgcacgaatacatactctatgccttttacttctttgatgtacaggtcttccacatttgcgccttggccttttgaaaagccgattgccgcttttgtccagttcccgtccgcatcaagggcaatttttttcgcaggcccttttgcttcttcttttatatcatcctgcttttctgcgacatccttaacgaacacagcaagacgtctcggtgtattgaagagtttcacttcaccgtgagtaatatttttttctttaagccagcctgtcagcttgtcgccaagctgaaccatgctttcattcaaaaagcgcgccggcatttcctctaatccgatctctaaaagtaaatcctgtttactcatgagaagaaccctcccctttaagcattgggaaccctagtttttctcgttcctcatagtaggtttttgctacttttctagctaaattccgcactcttgcgatatagcccgtccgctcggtaacagagatcgcacctttggcatcaagcaggttgaaagtgtgcgagcatttcagcacatagtcatatgctggatgaacaagtccgttgtccatttgcttgatcgcttctttttcatatgtgctgaacaattggaacagcatatcgacgtctgatgtttcaaacgtataaacagaatgctcatattcagccatcatgaataaatcttttactgtaaaccctgacgtccattccaagtcaaacacgttttctttatcctggatataagacgcgagacgctcaattccatacgtaatctctacagaaacaggtttacactctaatcccccgacctgctggaaatacgtaaattgtgttatttccattccgtcaagccaaacttcccagcctagacccgcgcagcctaaagacggattctcccagttgtcttcaacaaagcgaatatcgtgctcaagcggatcaattccaagagcacgcaaggaatccaaatacagctcttgaatgttatcaggtgacggtttaataatgacctggaactgatgatgctgatacagtctgttcgggttctccccgtagcggccgtctgccggacgtctggaaggctctacataagccactttccacggctcaggaccgatactgcgcaaaaatgtatacgggctcatcgtgccggctcctttttctacatcgtaagcctgcataagcacacagccctgactggaccaatgcttttgcaaggttagaatcatgtcttgaatattcatttcaagcacctccacttttctttcataagttgactgcgacagcaaccaaaaaactcccgtctctatgcttgccagccgcaaacatagggacgagagttctcccgcggttccaccctagttgctgagaacaaaatcccagcctcttttttaaaattgctcaagaatgcctttcgttgcgtgctcatccttagcttccaccgccctaaggtcgctttcatgaggtaaacgcaagtacttctttctctcactgcaacatattttataataaatgatcatataaaaagatggaccaaaagtcaacttttgttttcacccataagatgtttcatgctttccatttgatctaaaaagcgctttgattttaaatacaatcccgaatattcttcgtaatataaatcaatcacttgctttaattcagcttttgtttcctcttttaaggacacattgccgagcctcgacagatcaaaatagtaaaagagtcttaacagccttgccgtttgcggtttgatcggtatcctgtaaggatctttttcaaaacagcggtggcatataaaaccattatcacgaacagagaaatgaaaggttccgtcttggcttttacaatgtacacaatgatttagctcaggatacaggcccatgacaccgagcatcttcatttgaacaatgaaggtgataacatccggatctgttccttcattcagctgttttaatgactctaatatgaattcaaataaataaggatttggctttttttcttctgtgcctctgtcgactaactcagcaatataggcagcatatgctgttaaaaacaagtcttccctgatgcctctcatgctgaggatcatttccccctgctgaagcgttccgaggcccgatgttttttgcattaagaaagaaccatacaaaaagggctggctgactgctgataaacggctgttcggttttttggcgcctcgtgccataacacctatttttccgtgttctcttgtcagtaaagttacgattttattcgtctctccgtaatcatttgtgcgaagaacgattccttcacattttgtcagcatttccgcaccttcctcaagcaggagcggccaagaggtttataaaattggataatcaaatcgggctagctcatcttctagttcttcgggtctttccatgttctctttttccagttctttaaaaagaagatacgtatcaacatttcctgtttgagaaaatacgttccaggtaaaattcaacacaagaaacccacctttctgtagttaaactagcttacctaaactccaaattcttacctttatcttgaccagatgtcctccatttcatgttaaacaaaatttgctaatgtatccctgttcctgtgagataatgacacacacagctagagattaatattcgtcctctttaaagccaaaatcgcgaagctgggacattttattacgccagtctttctgcactttcacccacaattcaaggtagacacgggagcccaacagtgcttcaatatccgctctcgctctttttccaacctcttttagaaggcttccttttttaccgatcacgatgcctttctgggaatcccgctcgaccacaatcgttgccgctacgtgcacagaaccgttgtcctgccctttgatggattcgatggccaccgcaatgctgtgcgggatttcttctctcgtcaaatgcagcaccttttccctgattaattcagaaatgataaatcgctcagggtggtcagttacctggtcactcggatagaattgcggcccttccggcaaatacgcttcaatctgagcgagcaaggtttcgatgttatttccttctaaagcagaaatcggaacaatttccttaaaaggataacgtttgcggtattcgtcaattagcagaagcaattggtcgggatgaattttatcgattttgtttacgattaagaatacaggcgtagacatcgtctgcaatttctcaatgatgaattcgtcgcccttcccgtagccttcctcagcattgatcataaacaagatcaaatcgacttcttttaatgtattttgcgccactttcatcataaagtccccaagtttatgcttaggtttatgaatccctggtgtgtcaataaaaatggtttgtgatgtgcctgtcgtcagtactccttgcaccttgtttctcgtcgtttggggcttatcgctcatgatcgcgattttttgtccaatgactctgttcaaaaatgtagattttcctacgtttggtcttccaataatggatacaaatcctgatttaaagctttcgttcgtcatgtaaatcctccgatgaaaatgcgcctggcaataattcttccacagtcatttcttttatttgtccttgtaaattagtcagtacgacaataacgtcttttgtgcaaagctcagaaatcacctgtcggcaggctccgcacggagatactggtccaggggtgtcagccgcaacggccagcatctgaaactctgtatccccttcagaaacagctttaaataaagcggtacgctcggcgcaattgcacatgctgtatgccgcgttctcaatattgcagcctctgtacacttttccatccttggtaagaagagcggctcctacttggaatttggaatacggcgcatatgccatatcacgcgcttttaaagcttctgttattaattcttgtctgttcatgtgtacattcctctcttacctataatggtaccgctatcactttatattttacataatcgcgcgctttttttcacgcccatttctaaaaatgtaaaataaatgtaagaattttcagccattacagctttggcaaaaaaataagtaaaccaatgatacacgaaatcacggcaaaaacgcaaacagccccggcggcagcgtccttggccgctttagcaagagggtgatgtttgtcagttattaaatcaaccgtatgttcaatggctgtatttaaaagttcaagcgaaaacataccgcctatcaaaaggaatataatcatccactcaatcatgctgagctctacaaggaagccgcaaatgagaacagcgcaggcggctgcggcatgaaattggaaattccgctccgtccgcgctgtttcccatatgccccggcctgcatgcacgaagcttttgaagaatcgattcagctcatttctatgatcttttgagtccataagcgtccagcaattccttttgcttagtaaacatctcctcttcttcctctttcgtcatatggtcatatcctaaaaggtgcagaaatccgtgtacagctagaaatccgagctctcttttaaaagaatgattatactcctctgcctgctctcttgtgcgatcggcactgatgataatatcacctaaaaccggaggcatttcggcgcccacgatttcgatctcgccttccccctcttcttcaagagcaaatgagatgacatctgtcggagcatcctttccccggtattctttgttaatctgatgtatgtcatcattggaaacaatcgtgacagaaacttcagcctgatcctgaacgccttcacgctcagcggcaaattgaagcagattttctacttctttgagcatctcttctgagacgcttcccgtttcatcaacgatatcaatcagtaaactcatctatttcaccttcttagtagcctccggatattcaatccgggagtggaaaattccttttaatgttgcacagagcgtttttgcgattgtatccagctctttaaatgtcaaatcgcattcactgaactgtccgtcctgaagcttatcggatataataccccggacaagcttttcaattcgttcaggatttggattatgcatggatctgacggccgcttcaacactgtcggccactgatataattgcggcttcctttgactgcggcttcggccccggataacggaactcttcctctgtaatctggtcgcctttttccttcgctttatagtaaaaaaactttaaaagcgaggttccatgatgctgctcagcaatatcgacaagctctttcggaaatttatagcttctcagcatattcgcaccgtctgtcgtatgcgagataataatatttttactcaactgaggtgacagcttgtcatgcggattgtcaatattcatttggttttcaataaaatattgcgggcgctttgtttttccgagatcgtgataatatgcgccgactcttgcaagcaaaccattagccccaaccgcttcacaggctgcctctgataaattggcaaccattacactgtgatgatatgtacctggtgtttctgtcagtattttgcgcaatagcggatggttaggattagacagctcgagcagcctcatggtggataaaatgccaaagcccgtctcaaaaaacggcatcaggccgatgatcaatacagatgaagcaaaccccgacacaacccccatgagcattaacgtgccgatttcaagacccgacagcgcagtgttctggatcaataataaggatagaacgacaaccatattaataaacgccacgaaaagtccggtctgcaaaatctttgatcttgcattgtgttttcctaaaaataatacacctgaaatgccgctgatcaaataataaatccctatgacataattgaatgttcctgtcacaccctgattaaacatcatacttccgcaaatcgcaagaatgatacttcccaaaatggcaatgcgttcattcatcagcagtttgattaagatggcgcctgccgcaatggggaccagatagccgatattattatactccatcttctgaaacaaactgacaacctccatgatcacaagcaaaagtgttgtgataatcgagaataacagaatggattggtttttaaacttcagattttgtttctgtttttcaaaataatatacaagtgttgcaatgaaaagtccgatcataatcaatagcccgctgatcggtttaaagagatttgagttatttaataacccagtcagctcaagtttcctgtacacttcccgatcaatgaggtcattttcttccacgagcacttgcccctgtttgatttggacctgctggacattatctgaggcttcctgccgttttgcctctgttgctttcggatcgaaaacgtaattcggaataatagcaaaacgcccgatttctgtcgcagctcccaagtatttagacggaatagaattgctctttagctctttttctaccttatcctttgcatcagatagtttatccgaggggatttcactgctcatgaccgtatttactgcggtaatgaccgtatctctgacaaaagaaaagtcttcactgtctgctttcagcaatgtcttgatggaatcctccgatatagaatcattcacatctgatgtcaatttgtcctttacagatttgaccattgatttttccgatggtgatttactgccttcctccgatgattttttcacttcactaatactgtcgaatattgatgacacaaggtcaatccgattgtctgtatattctttttttaatgtatattgatcttcaaccgcgtcctcagcggcttgctttttttcctctgtggctttttgatcttctacggttgccggagcgtaaatggtcttgtcgctgactgaaaacaggtctaaatcaagtgtttccggcttaacatgtacaaagagcaaagcaaacataatggcagccagcagaagatacagcagtacatgcatggagcgggcatttttaaaactgctccattttttcgagctgcttttggtcttagccttctttttcaacacaagaacctcctcttgaaacatcaagcccataagcaatcataaaaatgacccgataacgcgcgatcgggtcattcagcattaattttgcttatcgtatgcttcaataattttcgcaacaagcggatgtctgaccacgtctgtctggtctagctcaatcatagaaatgccgtctattcctttcagcatctccttcgctactgcaagtcccgatttgacgcctttcggcagatcaatttggctgacgtcacctgtaatgatcattttagagccaaaacccagtctcgtcaaaaacattttcatttgagcaggcgtggtattttgtgcttcatcaagtataacataagcatcatcgagcgtccgccccctcatatatgcgagcggagcaatttcaatgatgcctctttccatcagacgttctgtatgatctgccccaagcacatcatggagagcgtcatacagcgggcgcaaataaggatctactttttcttttaggtcacctgggagaaaaccaaggctttcaccggcttccacggcaggtcttgttaaaatgatttttttgatatgtccgttttttaaagcatggactgcttttacgacagccaggtacgttttcccggttcccgccggaccaatgccgaatacaaggtcattccgcttcatagcggccacgtattcccgctgtcccattgtttttacacggattgatttgccttttgcgttttttgtaatttcttcttcatacatgctttcaaagtattcaagttcattcttctttgccattttgatggcgtaaatcacatcacgttcagagatctctatccccttgcgaattaaagcgaggagcgatcccagcagcctgtctgcaatctgaaacgattcatcatcgcctgacacataaatcgtctcgccgcgcgtaatgatatttacattcagatctttctccatcaatttcaaaaaagaatcttggttcccgaagagtgaaagcgcctcgtccgggtttttcagtttttgattcatcgcaagtaaatgttctgtcattcttcagtctccctgacaataggtgtggtttgaacgatatcttctataacttggtagagaataatcaactttactttaccattctcaacagtctggtgcaaaactttttcacttttcacctcgccgttttcgcctattttatcctctacatcctgtttacccaatttaatgccttcttgaactgcttcttctttcgtatattttcgcaaagcctcttcactttctctcgtttgctctttgacataggatacagggagcttaaatccgagaaaatgaagcgaatgcttttcttgttctgtttttggatgcttcaattcctcttttttaaacgtcatcccccagatcgggattgccaaagaaccaaaagaaagcttgtgctttgtccttactttgcccgtatagacgttaaataatgtttcaagcgggactgtcacttctgatctataccaggtttctccgtaaatttctgcttttgaggcgacttcctgctgatggtcttcgctgccgatcagtcccgaaacaagcagctgtcccttttcaacatgatcgtgtatggcggccatgggctgtcctttttgcacaaacattctcgtaatggttgctttctttttggcgacaatattgcgcgggctaacatatttttctttttcgggctcatttttctccacaactttcatatgaatggtcgtccccttcagatcaactccgacccaagtgatattgtctattccattggttaatgatttctgtattttttcgggcgacatcattaaaaactgcagacggccctttttgacgccgatttcattaagatgctgcctcatttgatgttctgtttcaggcttagcgcctgtcacatcaattttccacaccatattggacagcaaaaacaaaagaatgaaaaaaatcgcaaaaccgatcgtaaaccctatattcagctttgatttcagcaacaggaagggaaatcccttccgattgataaatcgggctttacatttaaatttacttcttacccgccgaaaggcatgtacatcctgaagctgtatatataacgatacggcttctttcttttttttgacatgaaagaccggaatcccctgtcttgtgcattcattaaggagccgctcaatccctcttcccgtcaattcaagctggaccttacccgaaaaaaaagacagccatttatttttcacaacatttccccctcggctttatgactcaacatatcgaacgacatcaatcgtaccctccaaaagtatctcttccggaagaatcgccttgatgacaaaatttttaccagatatgatgcactggccctgcttcagcatcagccgcacttcattctcactgaaaagcaaaaggcctctgtggttttctatgtagatatgaagtctgccaaccattgtaatcctcggcagatccatcataacgtccgggggaatttccaatgctcttgtcagccaagctttcatacgattctttctttgccccatacaaaaagaaccccctttcatctcatatgtatgatttgaaaggaggttctaacactttaatttttacgggccgggcgcatcgtacggtgaggttttttcgcccgtggaggtccgaacacctctcctagaacgatcccctgtacgacggtgtctttattcacctgaagcattttttgttttgtgtatactgttttttgtttggcagcagcaagatctcgttccagccctttcaggtttcttgctgtttccctgcgtctttcttccgcttcccgtcttgcctgttccatacggttagggataggtgcaggggcatcttcttttgactgcttcttttgaggagaagcagattgcatgtgttgaggttttttacttttttggctgttttgcttttcttctttgctctttttgccgaaaatcgcagaaatgattccgatgatcgctgcaataataagcggattggtcagtaaatcttccatcagcgttctcccttcttagagagattatgatttgcggtcttcatccgaagggtctttcgtcagcttgccgaatgaatcacgcatttctgtgtcagcatcgatgttcttgatattcatgtaatccatgacgccaatattcccttcacgcaaagcttctgccatcgcaagcggcacttccgcctcggcttctaccactttcgcgcgcatttcttctacgcgggcacgcatttcctgttcttgagcgacagccatcgcacgtcgttcttccgcttttgcctgcgcgatgtttttatcagcctcggcctgatcggtttgtaaaattgccccgatgtttttgccgatatctacatctgcaatatcaattgagagaatttcaaacgcagttcctgagtccaatccttttccaaggactgtctgagaaatcatgtcagggttttcaagcacttttttatgattatcagatgaaccgattgtagaaacgatcccctcacctacacgagctacaatggtttcttcccctgctcccccaacgaggcgctcgatattcgctcttactgtgattctcgctttcgctttcacttcaatcccgtccattgcaacaccggcaatgaacggtgtttcaatcaccttaggattaacgctcatttgaacagcttccaacacgtcccggcctgcaagatcaatggcagcacagcgctcgaatgtgagttcaatgttagctcgctgagcggcgataagcgcgttgacgactctgtcaacattacctccagccaggtagtggctttcaagctggtttgttccaacattaagtcccgctttatgggctttaatcagcgggttaacaacccgattcggaatgacacggcgaagcctcatcccaactagagtgaaaatgctgattttcactccggctgccaaagctgaaatccaaagcattacaggcacaaatgtaaaaaatactgccaaaacaatgatcgctactgcgacaattgccagaatcataagtgttgacggatccatataacttctcctcgtttctatttaaatttctctcacgacaatgcgtgagccttctactttaatcacttttacttttttatctttttctgtaaacgatccctccgaaacaacgtcaaggcgttcatcatcaataatcacggtaccggaaggacgcagcggtgtaaaggttatacccacttttcccattaagtccgtgcgcgtttgatttgaaacgtagccgctctccgtgtttgtagaatcatttaatatcaatttcttaaagaatttcatacgctttcccaacacccttgtcagtaaaataaaagctgtaatcgaaacagctgaggcgatcaagagagaaaccgccatgacagtgaagctccccgcggctaaaaacaggctcgcaataatcgctcccaaacccagtaatccaatgattcctccgggaagaaaaatctcaagcagaatgagaatcacccctgctataaagaggagaaccgtctcatacccggcaaggccggctgcaagatgcccgtaaaagaacagcaataacgcaatgagtccagccgttccagggaggccgacacccggggaaaaaagctctaccgtcagacctaaaaaagcgattgtcagcagaatagggacaatgaccggattcgtcagccatcttgctgtcttttctgcaaagctctcctttgcatagctgatctgcgccttttcgaacccaagcttctttacgagcgtggacaaattgtcagcagtgccttctgaatagcctacctcaatcgccttgtctgcgttaagtgtcagcagatctcccttaggcgcgccaacttccttggcatctatatctgggtcagccattgcgagcgcatattttggatcgcggttatttttcactgcggcatcttccatctctgccagccaaagtgattgagctttttggtcagcggcattgccttggccatcaacaatcgcggaggctcccatttttccgccaggcgccatataaatgtgatctgcttgaagtgcaatatatgcaccagcagacaacgcgcgtttgttgacatatgcagttacggggatctcactttcggttatcaaatcggccatatcaatagcagatttgaccaatccccccggggtattgatatcaagaataatatggtctgcatgtgcatcctttgcgtcttgtaacgaacgggacaaaaacgaggcgagaccctgttcgacatttttttcaaccgggatcacataaacagtttgtttttctgcttttgcgttcagctgtacgcctaataaagaaagtaaaaatatacccaaaagagcagcacggaatcctttgatttgaagcaagggcggtgtatccctccttccttttataataagtgccttctcttcatacgtaacaaatgtatcaaaggtttcatttttttatgtataaaaaaagacatctctcttagaaagatgtccttttctttgccatttaagacagttgactgctcacaagcttattaattaaacttccgtcagctttaccttttactttaggcataattgcccccatcactttgcctatgtccgcttttgagctcgcaccgacctccgcgatggtttcatttacgattgtacgcagctcttcttctgacagctgctcaggtaaataaacttctaaaatgtccagctctttttgaactttatctactaaatctaaacgattagcgtttgaaaattcctggagggagtctttacgttgcttaagttcacgagaaaggacagtgagttcctcatcctcggtcaaactgtctttcttaagcttaattgcttcattttgaagtgaagccttaaccattcgaacgacagtcagtttgtctttctcacggtttttcatatacagcttcatatcctggttgagacgctcaagaagactcataaatccaccctcttttagaatttgcgttttctagcagcttcagactttttcttgcgctttacgctaggtttttcataaaattcacgctttcttgcttcttgcaaagtacctgtctttgatacactgcgtttgaagcgacgaagagcatcttcaagcgattcgttttttctaacgaccgtttttgacattctctttccctccctccgaatacaccaatcgactacctttaagttacacatataaacatgtactttgacattataatataagccatcagtcaggtcaactaagtgagttcacttttccgtcatgagtgcgactgcctgtctatataatgaaagaaaggggttggtgaataggatgttaattctgattagctttactgctcttatattattctttctcgcaggcatgaacatgcttcgaaaaggcttaatttctatggcgtactcaaaaattgaagaacgtttgcttttatttacggaccatccgttaaaagcgtttcttatcagcattgtatttacgggaatacttcagagcagttcagcttttatggtcattgtcatcggctttgtaagtgcgggcgttctttcttttaagcggacgataccaatgattctggggacgaatgttggctctacttttacaactgaatttattgctatcaaaatggatattttgatctgggttcttttaataggaggtttattgttttttctgactggcaggtatcctttgaaacagctgggaacaagcttccttggactgggcatcatcttcttttgcatcagcggattcagccatcttgccgggccgctgacaaagctgaaaacgggagccgacgttctataccatgttaacgattcaaactggtccgctttgctcatcgggatggtgttaactgccatcattcactccagttctgtctgtatcggcattttgatgagttttatgaatgaagggattatcggactgacacaggcgatgagcgtcgtactcggatcaaatatcgggacatgcattacagctgtcatggctgctgtatccgggggatatgcggcgaaacagacagcgtatgcgcatgtggtatttaacgtgctaggggtggctctagtattgccttttctgaccgcagcgaccggctttgtagagcagttatcacccgatcctgcccaaaggattgctcatttcagccttttatttaatgtggtgacagctcttttgtttcttccgcttacaaacttgttttaccgcttgattcactttcttatcccggctaaataaaaaaccggtacattttaatgcaccgattttttaggttaagaagacaaacgcatatgttcagttatttcatcctcaaccacacggacaaactgtccttcgttgtaaggataacctgcttttaggattttgacttttacgattttgccgatcatatcttccgtgcctttgaaaacaaccttcatataattgtctgtgtaaccgacaaacatgttctcttcttctgtttctttataggcttcctcaggaataatctcaagcacttcattttcatactgagaagcgtattcttttgcaagctggtcagaaagagcaatcaggcggtgcacacgttcgtttttcacgttttcatccacttggtcttccattcgcgcagctggtgttcctgtacgtttactgtaagggaaaacatgtagctcagagaatttatgttctttaataaagttataggtttccataaattcttcttctgtttctccagggaacccgacgatgacatcagaagtaacagctaagcctggcagtgcttttttcaatttatttaaacggtctgcaaagaattccattgtatacttgcgtctcatccgtttaagcactgtgtttgatccggattggataggaatatgcaaatgattcactatcttatctgagcggtctaagacctcgatcacttcgtcagtgatttggctggcttcgattgaagaaattctgatccgtttcacgccttccacacgggtgtctaattcgctcaaaagcttagcgaagttgtaatctttcatatcttcgccgtagccgcctgtatgaatacccgtaagaacaatttccttatatccggcatcaacaagctgctgcgcttgtttaatgacctcttcaggatcgcgggagcggagcaggcctctcgcccacggaatgatacagaatgtgcagaaattattgcagccctcctgtattttcaatgacgctcttgtgcggtccgtgaaagcaggcacatcaagctcttcatatactcttgctttcatgatgttgctgacgccattaatcggctggcgttcttctcggtattggtcaatgtagccaagcattttttcacggtcctgtgttccgactacaatgtcgacaccggggatcgccataatctcagcaggtgaggtttgcgcgtagcagcctgtgacacagatgacaccgtcaggattttgacgaatggcgcgtctgatcacttggcggctttttttatctcccgtatttgtaaccgtacatgtattaatgacatatacatcagctgtttgttcaaagtctcttctttcatagcccgcttctttgaaaagctgccagattgcttctgtttcataatggttgactttacagccaagcgtatggaaagcaacagttgccattactgatcacctcttaataactctgtttgataagaaatcgcgctcaacgcgtatagcggagcggtttctgtccttaaaattctcggtccaaggccgcacggcacaccgtcttgctctgtgagccgttcaacctccgcttctgttaaaccgccttcgggaccaaatacgatcaatagagatgatcccttcggaaggctgcttacaatcgcgctgaatgcgcttatttccccttgcttcgatgactcctcgtatgcaacgacacatttatcgaaatcctgcatcctttgaagaagctgctgaaaagaatggacatccatcactcgcggcacttcgttacggtacgattgctcagccgcttcctttgcaattttcgtccatctttcccgctttttctttgcctttttgtcatccagcttgacaacagaacgcgcggcttggaaaggaataaaggcatgagctccgagctcagtccccttttggataatccattcaagcttatctcctttcggaaggccgctcgcaatatagacctttatcggaagctctctgttttcattcgtccattctatcacaaggcaggacactttatctttggaaacagattgaagttcacattttgcctcgaagccgtcttgagagcagcagataatctgatctccctcattcattctcatcacgttcacaatatgatgaacatcttcgccggtaatcgaaaaagccggcgcttcctctatttgctgcttcgtgagctcgataaaatatcgttgcatacgctgtgacacctactaactgttattttttcgcaataatgctgacccaatcttccattgaaaggatttctacaatggtaaagccagcttgttccagtgcttcttttacttcttgttttttatgaccgatgattcctgacgtaataaagtggccgccttcttttaagaggctgtacgcttgtgaagtaaagcgaagaatgacttcagccaaaatgttggccacaatcacatcatgttccccttcaatcccgtctaacaaattgttttgcttcacttgagcaatatcgctgactttgttcagcttgagattaaggcgtgcactttctacagccacgggatcaagatcgtaggcatgaaccgattcagcctcaagcattgcagccgcaatacttaaaattcccgaaccagtgccgacatcaatcaccttatcacccttttgcacaaagcgttcaagcgcctgaatgcagagtacggttgtcggatgtgtccctgtgccgaaagccattcccgggtccatttcaataatcagttcatcagtatggaccggcgtatattcctcccacgtcggcacaattgtaaacttttcagaaattttcacaggatgataatactttttccaggcagtcgcccactcttcttcatttacttcagaaatagtgatgtggtttctgcccaaatcaatattgtaaagaaggagattattaatcgtttctttgatgccgtctacagtttcgcccagaaaactgttaaccggcagatatgctttgacaatgacaccctcatctgggtaatcattggggtcgagctggtagatttccccgtacacattctcacgttctttaattaaatcaagcgggtcctctatcacaaccccacttgcaccagcttcatgcaatatatttgagataggttcgaccgcttcatgtgttgtgtgaatgcttaattcggaccatttcaaaactaccaactcctcatccaataattaatcgcctttaaacgcccgttttaccttgtcaaagaaactcatttcctgttcgtcaggcaggtttccgctgacttcggcaaattcgcggataatgtctttttgtttatctgtcagatttgtcggcgtaacgacgcggacgacgatatgctggtcaccctgtccatagcctctgacattttgaacgcctttgcctcttaatctaaatttcgttcctgtttgtgtaccggccggaattttcaatttcacttttccatgcagcgtcggcacttctacctcatctccaagagcagcctgagcaaacgttaacggcatttcacagtaaatatcatcgccgtcacgctcgaagaactcgtgtgcgcgtacatggaacacgacaaataaatccccagcagggccgccgtttattcctggttcaccctgtcccgagagacgaagctgctgcccgtcatctacaccggctggaattgtcacattgattttcttgcgttttttgatttttcctttgccgccgcagtccgcacatttgtttttaatgattttgcctgtaccttcacagtggtggcagacccgtctgttaacgacttttccaaacggtgtattttgctccacgtttaactggccggagcctccgcagtgggagcatgtttctggatttgttccaggtttcgcacctgagcctttacatgtttcgcacgtttcctcgcggggaatttcgatggttgtttctttaccgaaagccgcatcctcaaacgacagggtcatcgtatactgtaaatcagcaccctggcgcggagcgtttggatctctccgtcttgtgcctccgccgaaaatacttgagaaaatatcatcgaaaccaaaaccgccgaaatcgccgccgccaaaacctccgccgccgaagccttggttagggtcagtgtgaccaaattgatcgtaatgcgcacgtttttggtcatctgacagcgtttcgtacgcttcttttacctctttaaatttttcatctgatccggcttctttgttaatatcaggatgatatttttttgacagcttccgataagcttttttaatttcatcctttgaagcgctcttacttactcccagcacttcatagtaatcacgcttactcatctcgcttcactctcccgaatttctcacataaattagattgtatcattttgaattatgatttttcaattccttttatcccgggcaagaaaaaaagtcaaagccaagagatgcctgactttgactttctaatcattgaatcagattatgaaatgtgttcttttcggtcagctccggaagcggggctgacactaaaaagaacttattttttgttttggtcgtcgtttacttcttcgtattcagcgtcgacaacgttgtcatccgctttgccttcagcgtttgctccgccttgagcttgctgtgctttagcagcttcttcataaagcttcatagaaagctcttgaacgattgtttgaagctcatcctttttcgctttgatctcttcaaattcgtttttctcaatcgctgcttttaaagcatctttggcatcgttggcttttttcacttgttcttcgtccactttgccttcaagatcttttaatgttttctcagtttggaaaacaagctgatctgcttcgttgcggacttcgatttcttcttttttcttcgcatcagcgtcagcattttcttccgcttcttttaccatgcgttcgatctcttcatcagagagacctgaagaagatttgattgtaatgttttgttcttttcctgtgcctaagtcttttgctcttacgtttacgataccgtttttgtcaatatcgaaagaaacttcgatttgaggcacgccgcgcggtgctggcgggatatcagtaagctggaagcggccgagtgttttgttgtcggcagacattgggcgctcaccttgaagaacatggatatcaacagctgtttggttatcagcagcagttgagaacacttgagatttgcttgtcgggatcgtcgtgttgcggtcgatcagttttgtaaacacaccgcccattgtttcgataccgagagaaagcggtgtaacgtcaagaagaacaacatcttttacgtcacctgtgataacgccgccctgaatcgcagcaccaagcgctacaacttcatccgggtttacgcctttatgcgcttcttttccagtttcttttttgattgcttcttgtacggcagggatacgagttgatccgccgacaaggatgactttgtcgatttcgcttgcagaaagtcctgcatcttgaagcgcttgacggacaggacccattgtgcgctctactaaatgagaagaaagctcttcgaatttagcgcgagttaatgtaagttcaaggtgaagcggtcctgcttctccagctgtgataaacggtaaagaaatttgcgtagaagatacgccggaaagatcttttttcgctttttcagctgcgtctttcaaacgctgaagcgccattttgtcttttgacaaatcaatgccgttttcttttttgaattcagacacaagatgatcgatgataacttggtcaaaatcgtccccacccagacggttgtcgccggcagttgaacgaacttcgaatacaccgtcgccaagctcaaggatggaaacgtcgaatgtaccgccgccaaggtcgtatactaggatcgtttgatcttcatctgttttatcaagtccgtatgcaagcgctgctgcagtcggctcgttgatgatacgttctacttcaagacctgcaattttaccagcgtcttttgttgcttgacgctcagcatcgttaaagtatgcaggaactgtgataactgcttttgatactgtttcgccaagatagctttcagcgtatgatttaaggtgttgaaggatgatagcagacacttcttgtggagtgtaatcctttccttcaatttcaactttataatcagtacccatatgacgtttgatagacataattgtgttagggtttgtaatagattggcgtttagccacttcccctacttgacgttcgccgtttttaaatgcaacaactgatggcgttgtgcggtttccttcagcgttagcaataactttaggctcgccgccttcaagcactgccacacatgagtttgttgttcctaagtcgattccgataactttactcacttgaataacctcctgctatgtaattattgattcactttgaccatggaagggcgaatgacgcgatccttcagcttatagcctttttgcatttcctcaacaacaatgttggagccgtagttttcgtcttcagcctgcataacagcttggtgcagattaggatcaaattcctgccctacagcttcgatggcttcgacgccttcttttttcaaggcttctacgagctgacggtggaccatttccattccctggagcaaacttttcgtctgttcattgtcggcttcaacctgaagcgctcgttcaaagctgtcaagagccggcagtaaatcagtcacgatattttgagaacggtatttttgggacgcttccatctctaaacggctgcgtcgtttatagttttcaaagtctgcttgaacacgcaaaagtttgttttctttttcctcaagcaaaccttgcaattcgttaatttggttttgaagaagttcgctttcatttgtttcttcctgctgttcatcagcggcagcttgttcttcaatgatttcttgctcttctgtttcgttttgttcaacggtttgtttttcttctgacattgtgttcacctccctcaaagtgtaaggagaaggacaggtgctgcccttcgataaaatttgccaaaattcccttattcatcatacagacttgttaatgcttttgacaagtccgaagtcacatgctgaagcaggctgacaaccctggaataattcatgcgggtcgggccgatgatcgcaattgagccgatctgcttctggtctacggaataagaagccgttatcagactgcaattttccatctcttcatagtcgttttcttttccgattttaatcgaaattcccgtgtgcggggattgaaccagctttaaaacatcctgttctttctcaattaatgaaaggagcgaccgaactctggtgatatcatggaactcaggctggttcagcatattgattttcccgccaaaaaacaacttttcaacgtgatttgtggaatgaaatgttgaacgaagcgcgtcgagtatattgtcatagtttttaatgtgctgtcttaggtacatgacaacttccttaaatatgcgctcattcagttcatccattggaacgccgcttaaacggtcgttcagtatatttaccagtttttcaatatcagacagatccattttggtcggaaagttaatcgttttgttttccacatgccccgtattggtaacgagaatcgctaccgccatatcaggctgaatcggaatgatttgaatctgtttaaggtaattctcactcaacttcggcccgagtacgatggatgtgtaattcgtcagatcggacaaaatttgcgctgatttttgaactgtcttctccagctcgaaaattttctctttgaagatcgagtggatttggtccaggtcgcttttcgtcaatttgacgggtgacagcaaatggtcaacatagtaccgataccctttttctgacggaacacgtcctgaggatgaatgggttttttcaataaagcccaattcctccaagtcagccatctcgtttcttattgttgcagagctaaatgtgatttcatcttttttcgaaagagttcttgatcccaccggctgtgccgatttaataaaatcgttgattataacctgaaggatcagcagctgacgatttgttaacatcatcatcacctctgttagcactctcaataagcgagtgctaattctataacaaaagtatcaaaccacaagaaaaatgtcaattataactcacccaaaaaagcgccaaaaacttcattgcctaataatttcccttgatgagtcaaataaacggcagactccgaattgtgaatcagccctttttcagcgaggtcttttaacacgcttgggaaaagtccatccagggaacggccgtatttttctgcgaatcgttttttgctgacaccggctgtttttctcaaacctaaaaacatttcttcctcaatctgttcttctgttgttacttcatgtgtatctctgtacggaaaacccttttcagctatcaggtcaatgtaatgcttaacaggtccgacgttcactgttcgtgtgccgccgatatatccgtgagcgccggctccgaaaccgaaatattgttcgttgctccaatacgttagattatgcttagattccatgcctgccttagcaaagttgctgatttcatattgatgaatgccgtgagcttccatctggctcatcaccatttcatacatttcagcttcctgctcctgcggcggaagatgaagccgccctttttgcatcaaattataaaataccgttttcggttctacaataagggagtaaacggaataatgctcggcatccagtgataaagcagtgtttatggaatgttccagatgcttgagggtttgccccggaagcccgaacatgagatcaagactgatattctcaaaaccgatttcccgcgctctttcaaaagaggtgaatacatctttttgcttgtgcactcggccgattttttctaacagatcgtcttcgaacgtttgcacaccaaagctgaggcgatttacgcctgcttcttttaatatttttaatttctctgcggacaagtcgtccggattcgcttcaaccgcaaattccgataagtcgcttgagggctttagcacgcggttgatcatatctatcagctttttaagctgttcctcagacagggaggtcggcgtgcctcctccgataaagattgttttaagatcaggctgcccggtttttgctattgtatttatcatttcctgttcgagtgcgtttaaatactcgtcgactggctgactttgaataaaatatttattgaaatcgcagtagtggcaaatatgctcacaaaatgggatatggatataagctgatttcaacggattcaccttctttacagaaagaagccgcagtacaagactgcggcggcttctattgttttttcggactgtcgtccattttcagaactgccataaatgcttcttgcggcacttcaactgagccgacctgcttcatacggcgttttccttctttttgtttttcaagaagtttccgtttacgcgagatgtcccctccgtaacatttagccaatacgtttttacgcattgcttttatggtggagcgggccacgattttctggccgattgcggcttgtaccggaacttcaaactgctggcgcggaatgagttctttcagtttttcaacgatcacttttccccgttcatatgcgtaatcacgatgcacgataaaggaaagggcatcgattttttcaccattcagcataatgtccattttcacaagcttggacggtttgtagccgatcagttcataatcaaaggacgcatagcctttagtgcttgatttcagctgatcaaaaaactcatatacgatttccgctaatggcatatcataaatgatgctgacacggtttgcgtctaaatactgcatatcaatgaaattgccgcgttttccttggcaaagctccattacagcgccgacatagtcattcggcaccatcatcgtcgcttttacgtatggctcctcaaccctttcgatcttttgaggatccggcatgttggacgggttgtcgacaacgaccttttcgccgtctgtcatatacacgtcatagataacgcttggcgctgtcgtaatcaggtcgatgttgaactcacgctcaattctctcctgaatgatctccatgtgaagcatgcctaaaaatccgcagcggaacccgaatccaagcgcttgcgaagtttccgcttcatattgaagggaggaatcattcagctcaagcttttcaagagcttcccttaaatcattatacttcgctgtatcaatcggatacaaaccacagtacaccatcgggtttagcttgcggtatcccggcagcgcttcttctgcaggattggcagcgctcgttattgtatcaccgacacgtgtgtcaccaacatttttgattgaggcagtcaggaagcctacatcaccgaccgtcagttcatttgtcggagttgctttcggcgtgaacacgcccacctctgttacttcgaattctttgccggttgccatcattttgattttttgtcccggctttaccgttccttcaacgactctgatataagccacgacaccgcggtaggcgtcataaagcgagtcgaagatcagcgctttgagcggcgcctccggatctccggtcggagctggcaccttttctacgatttgttctaaaatctcctcaataccgataccggcttttgctgaagcaagcacggcttctgatgcgtcaaggccgataacgtcttctacctcttggcgcacacgttcgggctcggcgctcggaaggtcgattttattgatgaccggaaggatttcaagatcgttgtcaagcgctaagtagacattggcgagcgtctgcgcttcaatcccctgggctgcatccacgacaagaatcgctccctcgcaggcagcaaggcttcgggatacttcatacgtgaagtcgacgtgtcccggcgtatcgattagatgaaagatatattcttctccgtcttttgctttatatttaagctgaacagagtttaatttaatggttatgccccgctcacgttcaagatccatagaatcgagcaattgttctttcatttctcgttgagtgattgccgacgttttttctaaaatacgatccgctaaggtcgattttccgtggtcaatatgggcaatgatagagaaattccgtattctcgattgcctctctaaacgcttttctttatctgtcacaatctatcactcctactattaaacgcaaaatacactagcttagattatatcaataggattgtaaagattcaatgtaaaacaagaaagagaaaagttccctatcatatctgggttgcttttctctttcacgtacttattgattcatatcccgtatccattcatacattgactgggcagtattggttacggtgtccgaaagcgcttttccggcttttgaaaacatattgaatgtctccaccttttccagctctttttgtttttcttctaaatcttttgccgtgactgtttctcctaggattgaggcttctttttcattatcttttccgtcggtgagcgtaaacgcccccttcagtgaagggtcatgatagcctttcatactcagcatcccgtggtttgcctgctgcatgccgaacagaacgcctaaaaacatgatcgtgacaagcagtaagcactttccaaagtatgcaatcaaatcaaccacctatttcttattgttttttcgtctccccgctcgctgcgttgaccttttcagcatcccagtacatttcgctgaatacgtccgcggccgcgttagccgcacgctgcagctcttcgagattattatccactccgccaaactcgagcaaaagcgctctatcggttaaatcctgattgtaaacaccattatcgcctggcgagcctttggaaaagacacctgtgctaagtccggggtattttttctccatcagtttatgaagctcactcgcaattttatagttttcttcgaagtttttgctttttttcccgacgacaaaggctaccctggcatagcttttccctttaatcgttgcggttgtgtcttttttgcgccgagagtctctgtggatgtcaatgatatattgcagatttttgtttgaagcgagggcgtctttcacgaccggccttgattcatcataggacctggcatagtttaagccttttttattcaattttgactgtatatcggttttattcactgtggctccgattccctgggattcaagcgcttgtccgaacatatctcctacaagcgtgacattggctttagaatggcgcgccatgtcaggatcggtctcgccttttaatagagggagatatgattccgtattgtgcgtgtgatagataaacacgacctttttatcacctgttgtttgtttcggcggatctttttgcgcattatctgattgcgtttgctgtttttcaatctctgccaaattcgcttctctttcttcctccatcaccttagacggcggcggcgattccgcaggcatattcgtataatccgttccttgtccagctaacaaaatctcggtatcaaattgtgcaaatcctggcagctcccgaccgagaaagctccgcggatcttcgaggttaatgctcgtcgccagctttaaagaaagacgagaaagatgaaatgagctgtctgtttgagagaggtcagaagcgaaataatggttttccatctgcagcaaatgtgcaaatacgtcacccggcaattcttcagcaatcccataaaaagagtcagacgacggcctaagttccggccggagagacgtcagcacaccggatagaacaaaaatcacgataaggcttacgataaatagaaagatggcttttaccgctttccctccatttaccgcaacaacaatctgtctgtttctgcgtttatttctcattgaatccctccagcgcttgtctagtaattactctatgaacaagctagaggaagtagaactgtttagtgattgtaggagcctttgttttcttgtgacactttttcatgaagcgctgtgtttaatccgttcgctaaaacatttgccatatcgtcgataaatgaatcgacttccttcggtgtaaccattaagttgtgccctaaaggcgaaagcacctcgtgaatgagctgccgtttttcatcttcttgaagggttccgacaatacctaggaacgattggcgctgcttttgatcgggaagatcgtcttcagtgagcactttctttttcccaaacgtcatgcctgccggaacaagcgatcttgatggcctgttatccttcatttctctgccaaaatgttttaatatgtagtccaccgtgtcgctggcaattgtcacggcatcaactactgtcggaacaccgatagcaatcaccggaacaccaagcgtgtctttgcttaaatcttttcgtttattccccactccagaccccgggtgaatgcctgtatccgatatttgaatggttgtgttgaccctttccaccgcccgcgccgccaacgcatcaatggcgatgacaaaatcaggcttcgattgctcaatcacacctttaataatgtcacttgtttcgattcctgttatccccattacacccggtgcaaaagcactgacaggcctgtaaccctcctgtacgttttccggctgaagcttaaacaagtgccttgttaccaacagattttctactgccatcggtccaagcgcatcaggtgtcacgttccagttgccgagcccaacgatcaaacagctcgcatcttttgagatattaaggttttcaagaaaagctgagaattcctccgcaaagacagcagagaccttctcttgcatttccgaatcattctccctgattccctgtgcttcaagcgttaaatagcgcccttctttttttcccgaaagctctgcgccttcctttgtaacatcaactgtgcggattttaatgccgccgtgatcacgctctttttcaataaagcctttaatttcttttgtcggcacagcctgctgattggccattgcttccttcgtttccactgccaaatcggtccgtatcaaatactgattcacatccagctcactctttttcatacaggggcctccttcacattaagtacctatattgttgccatttgctgaataaatcatgctaaaaagagaaccttcaatgaaaaatactttacatttatattgcaatctaaaggtgtgtttgatagaatacaatttgttctattgtgaagaagatttaaccttaagacactgtgctacaggttgtatcttaggaggtgaaacacatgccaaacattaaatcagcgattaaacgtacaaaaacaaacaacgaacgccgcgttcataacgcgacaatcaaatctgctatgcgtactgcaatcaaacaagttgaagcttctgttgccaacaacgaagttgacaaagcgaaaactgctcttactgaagcagctaaacgtattgataaagcagtgaaaacaggtcttgtacacaaaaataccgcagctcgatacaaatcaagactagcgaaaaaagtgaacggactttctgcataatataaaaacgatcctcaataatggggatcgtttttttcatttctttttaacagctgtaaaaggaacagttcgagcaggagctgcttgtcctttttcccggttttcatctcatagtccatgacggcaagctgttcaataattaaacggagctcctcctctgaaaaaagccttgcttgatccatcgccagctttacccgaaatgggtgaacttttagattagaagcgatttgtttttgtccgtatccctgttccgcgaagtacttcgtctgcagaatcagccggaactgattcgaaataagcgccataattttgatcggttcttcattttgttttagcaaatcataaaaaatttgcagactctctgttcgttttcggttgacgattttattgatcagctcaaaaatattttgttcaaggcttctagcaacaagcatttttacatcatccagcgtaatttcttcacgatctccaataaacgtgcagagcttttgaatctcctgaaaaatcgatgacagatgaccgttcacaagcagaaccaaatgctccgccgcttccgtgccgattgttttctgctctgtttttgcaaggttgacagtaaagtctgtcgtttcctttgcatttaattccttcgcctccatcataaacgcgtgcttctttaacgctttcgtcagcttttttcgctcatcaagcttttcatacggagcaagcaggacaaagactgtgtaaggcgcaggtgattgtatatatgattcaagcgcactgacgttgtgctcaattttttcttttttcttttcacctgttaaaaaatatggatttttcacaatgacaagacgccgctcccccataaacggaaacgtttcagcatctgcaatcgcttgatccagcgggtcctcttccagatcaaaaacggatagattgaaatcctttgtctcctgatcaacgaccgtctgtctgatcctgctgacggtttcttgcagcagatatgtctcttttccgtataaacaataaactggatggacatctccttttttcaggcttttccacacatcaaataccattgttgtacgacttcctctctttcatcatccccttctatcctaaattgagtttgcaaaatagtaaagaggaagcctgactgctgcttccccatttatattaaacgcctgttcgcaagcccccgggacagcttgtaaaaaggcgataatcaccagaacagaaaacgttaccttagcttctagatttttcaaaacaattccattatacttaagtcagtcaggagggataaagttgaatgattttgaaaaaaacgttcaaagcaaacgaaatgatgctgtagattcagctgttggttttgttgtgtccttcggatttttcgccttcttgtttgtcatggcaacggttattcacctagttggttcataacagcgactgcccgggctgctgatttctcggcagtcttttttagttcgtctctgttatatctgatgtatcatatggaggatagacagaaaaggttccaactctgtttttgtatctatattggatcgttccgttttgatctgttcgcagcacgcggatagaatgtctctgtaatagttgcagaacttcttgatgaggatgatggtaccgattgtttttcccggctgagataatggccgttttcggctgaagctgttggatgaattcttcaccggtagagcctttgctcccatggtgccccacctttaagacatctgctttaatatttggaaacacgtccatcacctcctgttccccttctttctccaggtcacccgtcaagatccagctcataccgcccgtctccatccacagaacgagagaggaattatttttgcttgccggatcaggtgctccaggtgacagtacatggaactgcaaatcctttatttgcaatacatctcctcgcttcacctcttcaattgtcactccctcttctctggctgtctgcagcactttctcatctttaggttcagaaacgaaccctttcggaatcacgaggcgctttactttatgatgcttcagcagagtctccgcctctccgatatgatcttggtcagcgtgcgtcagaattaaagcgtcaagctgtttgattcccttagcagttaaaaacggaatcagcaccttttcccccagtgaaaacggatgctgtttttcgcgccaaggctctgacgagtaagacaaagtgccgccggtatcaattaagacacgcccccgctgatgcggagcacctacaaacatgctgtcaccctgtccaatatctatcatatccacttctccttcggaactaagacacggatatataaagagcagaaacagcaccgtgcagcaaatgcctccggttaccatcaactgcgacaaggagcgtttttcaatcgccataagcaataggatgatcgtgaccgtgaataaaaaaagcaaaacaggtgcaggatgtgcgatcataatcgtgaacacatcaacatctgcaatgtttgtgattagcctattggtccagcttatcaataaatcaaaccagctgaaaaacaatctcccaaacgaagcggaaagacttaatagaagaacacctgctacagctcccggcaaaatacagaaggtataaaatggtaccatcaacatattcatcggtacgctgatgatagaaaactgatgaaaatgatatagaagaatcggaagcgagcccagctgagcgatgagtgatacaattgtcagctgtcccaaggaggttttaacctgctgaaaaatagaagaggatagaattaaagaaaaactgacggcgaacgatagctgaaaaccggcttcaaagagatgataaggattgaagagcagaaggacgatgtatgaaaggcaaattgcagttgcagagtggacacgccatttgacaaggcttccagctaagtaaacacccgacatgagagcggcgcgtagcactgaaggagcagcgccggtcaacatcacatagagcggcagaaataacagcaacagaattgacgccttttctctagttataccaaggcgaatcatgatataaaacaaacctgctgtcaaaatccccacgtggagtcctgatattgccaagagatggacaacaccaagcttttgatacgcggtaagcacttcatcctccacataaaatctgtcaccaactgtaagtgcctgtacaatccctgctgaatcaggaggcaaaaggctgtttgtgaatgatatgatatgttttctcaagctgagcaccttgtacttaaaattttcaggttcgctgcagttttggatagacgtgacagagtagttccaatgaatatgctgccgataaagatactcgttataatcaaatgcacccggcacagttgcgtgattcggttcttccaatgtaccagtcaactcacatgacattcctggttctatgtataacagctgttctttttcaccagcagactgaatgcgatacgcagcagcccatttttccttatcaggtgtctcaaccatcatagacatacggtcgccgtcaattttgggaatagtgtcaatcactgccttgaattgataggttccctgccgataggaagagacattctgagaatctgtgactgcatacagtacaaaaaacaatataaaagagaagaaacaaacaataatgagaaaagcgtgcctcgttttgattaaaatgatgaggagaaagaggatgaaaagaaaaatagcggggaaataagcggcggcagtaattccaaccgttgccgaagctgccgccataggcaataacaaacgcgaattacgcattcatcacacgtagctcgtgaaaagtgtattcgcctgttcatgtatctttttcaattcttcctccgctaaaccggcatcggccaatttccctattagacccgctacaaatgaaagcttttccctgtttttcagatcaacgatcatttcatcgagttcaacctgttcaactgttacacccgcctgttcaaataattcctgcgcatacggatgtgttttgtaatcctcagcataataaaccgttttgataccagcttgaataatagatttgcagcattgaatgcacggataatgcgtcacataaatctcggctccatcagtcggcaccccaaacttagagcattgaagaatcgcattcatttcagcgtgaatcgttcttgcgcaatgatcatctatcattaagcatccttcatctgcacaatgtacaccgcccgcgattgacccgttgtagcctcctgctatcatgcgtttgtctctgactatagtagcgccgacagataatctcggacatgtgctgcgcagcgccaataaatggctttgagccataaaatattgattccatgaaattcgttccacgttgttccctccaaatgttgtgttgcctgacctttagtttacctatcataatgcatgaccgtcaaatcactttactgtaatggaagactttattttctcaaatgacttttcacctattcctgaaaccttagtgatatcttcaattgtttggaaacgcccgttttcttcccggtatgcaataatagcttcagctttggatggccccacccctgagatgccttgtaactcctctaaggttgctgtattgatattcaccagcggccccttccctccatcgctttggacagaccctccggtaccttgctgcactgctgtttcctctccctttttcgggatgtacaccactgtcccgtcctgaagaacctcggccaaatttacttgcgcttcgtctgcttgtttactggtcccgcctgctttctcaattgcctgagatactctgtcccctgttcgcatttcataaacgccaggatgctgaacagcacctttgatgtctatcacaattgtttcgcttgactcgtcgttgtttgcttcctgctttaccactgtattttctgtctctgttggtacagcttgcttcaccggctctttatttttccctgtggccagaaagatcataatagctgtgaaaacagccgcagaagccgctaaaataattgttttcttatgctgattcaaccaattcatcgtgcatgttccccgctttcgtcatattttattttcataacacatatggtttagaggataatagctcaaaggaggggaaaccattgaagataggctttatcggcacaggaaatatgggtacgatccttatcgaatcatttattgaatcaaaagcggccgatccctcaaacataacaatcacaaaccgcacaattgaaaaagcgttgcacataaaaaaccgctacaacagcatcaacgttaccgaaagtctcgaaaagctcgtttctgagaacgagatgatttttatttgtgttaagccgcttgatatatatcctttactggcaagagcgttaccttatttaagaaaagatcatattctcatttcaattacaagccccgttcaaaccgaacagctcgaacaatatgtgccgtgtcaagtggcgcgagtgatcccaagtattacgaacagagcgctggcaggtgtttctctcgtcactttcggcacaagctgcgacgaatctgcaaaaacgaaaatcaatgagctaatgcagcatatctctcatccgctgcaaattgaaagtgacatcacaagggttgcatcagacatcgtaagctgcggccccgcttttatgagctatctgattcagcggtttatagatgcagctgtcacggaaacatcagtatctaaacaggacgcgattttgatgtgtaaggaaatgcttgtcggaatgggaaaactgttagaaaccgaattgtataccttgcctgcattacaggaaaaggtttgcgttaaaggcggtgtaacaggagaaggcattaaagcgctggaaagcggtgtgcagaatatgtttcaccgggtatttcaaaatactcatatgaagtacgaggaggatatttccgcagtgaaaaagcagtttcatgtgtagacgagtatgtcatactttcgtctgtactgcaaaagcataaaaaagcattttaaaaaaccatcgttttaagaaacgatggtttttgatttctgcgccttgaaaaagaggcgttctgattgtgctgatggctcggtatccgtaaaatcagctgtcacgcgatggagctgaaagccgcagttcttaagcatttcttcgtattcttccaccgggaacgttctttgctcgtgtgtctcatcaaaacgatcatacgcttctccgttccacacaaaaaacgacatatcatgaatgacagaaagctcgtcacttccggcaaagctctgccaaatatagctgatatcttcgtcctggtcagcaaatgtgctatccggaaagacttccgcaattttataagatgaatgaacatcaaacagcaaaatgccttcaggctttaatacccgaaatacacttttaaaggtttcgatcacatcattttttgtttttaaataatttaatgagtcacagcatatcacaacagcgtcaaattgaccgtcaaagccggtaatctctctcatatcctgctgaagaaataaaataggctggctactcgataccttttgctgggcgaaagaaagcatctcttcgctgagatcgatgcctgtaacctcgaagcctttttcggcaagccggatggagatttcccccgtgccgcatgccagatcgagaatacggcctttttccgggagagatgcttcaatccattttgtccattgatcgtaaggcgcgtgtgacattaactcgtcatacacgcttgcaaagccctgataaatcattgattcattccaaagtcaagatctgcgagcggagcgtctccccacagcttttcaaggttgtagtagcttctttcatccttgtggaagacatggacaattacatcgcctagatcaacgagaacccatcttgcttcatcaaagccttccatctttttgacttgaatgccgttttcatcagcttgatccttgatttcacgggcaatagcctgtacctgtttatctgaatttccgtggcagatcagaaaataatcagcaaccagagaaataccttccatatccagtgctaaaatatcctctgcccgtttatcatcgcaagccgcagctgcgatctttaaaatggacttttggttcattcacaaattcctcctgttcagctgccagacacaagccagttatacgttaaaaatgtgtctggaaaaaccggttgattttttttcataagaaaaaccattgtatttttaatggactgaatcagcgcttgattcaaatctgtctcagcaagcttacgcacctcatcgacaccgggaaatgcccggtttggctcaatgtaatcggcaacgtaaatgactttttctaaaagtgtcatgccggggcgccctgaggtatgatacctaatggcgtcaagaatgtcttcatcttgaacccctgcctctctttggaccaaataagcgccgaccggagcgtgccagagctccggattatgatccaataaatgcgcaggcattttttcacgcgcaataatttgtttcatttcttctttcgggcggaatttggcgtaatcatgaaagattgccgctgtttccgcttttttagaatcggctccaaaacgctccgcaagttcgatcgccgtgttcatcacgccaaccgtatggatatatcggtgttcggtcaattgctgcttcacgcatgcaagtgcctcctcacgattcatataaaccattctcctctacatacttcttcactttatcagggattaagtagtcagtgggcttcttgcttttaaaccgttcccttatcatagttgatgatacctcaaattccggaacgtctgcaaagagaagcggataaggggtttcaacatgaaaaccggggcgctttactccaataaattgaatgaggttcagcagctcgtccagcttataccatttcggcaaatattcaatcatatcagcgccgataataaagaacagctgatcatttggataacgctgcttcagtaaagaaacggtatcaaaggtatatgatggcccttctctttccatttcaacaagctccagcttaaaggacggattagattgaattgcaagctttagcatttccacgcgatgaaagctgtcggtatagtcttcgttctgtttatgcggcggaatttgattaggcataaaccaaatttcatcaagccccgcctggtacagcacctcattcgccattaagaggtgaccattatgcggagggtcaaacgtgcctccgaaaattccgattttcttcatttcaaccacctttaaggaagctcgatttgtttattttcctttgattccttatataacacaatcgtattgccgattgtctgcaccaattgagagcggcttccttttacaagagcttccgctacatcgtttttatcctcttcgcaattctgaagcacgctgactttaatcagctctctcgcttcaagcgcctcagtaatttgtttaatcatgttgtcgtttactccgcctttacctacttgaaaaatcggcgttaaatgatgcgcttttgaacgcaaaaaacgtttttgtttacctgttaacattctgttcctcctaattttcctattacaatagatctcattttttcaatatcaggctcttgtccagtccacaattggaaagacaatgctgcctgttcaacaaacatgcccacaccatcgagtgttttcaagcctttttggcttgcttcttttaaaagggccgtctgtattggattatacacgatatcacatacgacggcactgctcgcggcacgctgtaatgaaagcggcacatcgtccacgttcggatacatgcccacagacgttgtatggatgataacatcatactgctcaagacgttcttctgcttcttttatgcttaatacttctttattgtgaaacgagggagtagcttctgtaagccgctttgctttttctaacgtccggttgcaaatgtcaaattttttcggggtatttcggacaattgttgtaaaaatggctctcgccgctccgccagcgccgatcattaagaatgacagttcagagatgggcttgtctaataccttcattaatgacttcacgaagccttccccatcggtattgtatccgacaagcttatctccctctcttctgaccgtgtttacggcaccgagcacttttgcactctcatcaatatgatccagataatccataatggaaaccttgtgcggaacagtcacattgattccttgtacgcctagagctcttattccttttaccgcatcctccagatcattctcttctaccttgaaggcatgataatgtccgtcaagcccgaggtctttcaatgatgcgttatgaatatcaggtgacatagaatggccaatcggatttccgataaccccgtacagctttttcatactcctctccccttttcttaaattaatgaacgccgaacaaatacatgaacgccttttggcgcgtatgcagttacctttttatcggcgtcatggacagtaacccagcctaacccagagaaaacgatatctgtctttttgtcttttatcgtaaacgtatgggcgaccaattccggaaactcatccatttcatctttacccggaggtgtgagcaattcccctgcatgcttttcataaagcgcgtctgcattttcaagttttgttctatgaatcatcagttcattcggcatatagcaaataaaaggagatctttccccagacacataatcaaaccttgcaagtccgccaaaatacagtgtttgctgatcattaagctggaatgtgcgaggcttcagctcctttttaggagataatattttcagatcctttttattgacataatgcgccatttgatggttgttgataattcccggtgtatcataaagcgatgaaccgtcatccagcgggatttcaatcgcatcaagggttgtgccaggaaattgggatgttgtaataatatcttcttcacctgacacttctttaataatccggttaataaaggttgactttcctacatttgtacatccgacaacatagacgtcttttccgttgcggtaatgctcaatcgcgtcaattacttctctgattccctggccgcgtcccgcactgaccaaaaatacgtcaaccggttttaagccaagctctttcgcttcacgcttcatccattggatcagacgctctcttttcagtgacttaggcaaaatatccgctttattgccaactaataagatagggtttccccccaccaagcgctgcagcccattaatccagctgccgttaaaatcaaaaatatcaacaatttttacgacaagagagtccgtttctccaataccgtgaagaatgttcaaaaaatcatcatcagttaaggagacatcttgtatttcattatagtttttcagtctgaagcaacgctggcaaatcacattttctttcgtaagcgatgcaggcggcgcgtaccccaaacctgttttgtcctcggtttggatcgtaactccgcacccgatacaaacaaccttttccatttcttactcctcccactgaatgtgcccttttcgtttgagagcactcagtattctgcgttcgacctggcggttaaagcgcgtaatgaatccgtcagaggaagcgactggcacgaccaaaatcgtatggtagccgtttcggtttcccccgagtacatcggtcagcagctggtctccgatgacaacgcagtcctcttttttcagctccatattgcgcaccgctctattaaaggctttacccatcggttttcttgctttatagatgaatgggattccaagcggttctgagaaaagtttcactcttctttcgttattattagagacaattgtcactttaatgccgtgttccttcatttcttcaaaccactcgatcaatcgcggcgtcgcgttcggcctgtcccattcaacaagcgtattatccaggtcagtaataatcccttttacatttcgttcctttaatttctcaggtgtaatatgaaaaatattttttacaaactcgtcaggtaaaaaaaacttttttaacaaaacccgcacccttccctttttctttctttcaaaatgattgtcgaaaaaaatcgaacttgcgcctaaagaaaaactgagcaaaaaaatttcgacaaaaattgggtttcttcaccaggtgtggataaatttacacacactatccactcttattacatcactctttagacaaattataaacacgatactcacaagttatccactttttggtgtggataacagaacgattgttcttatatgcatttcatggtagattaaagataacttcaacctcagatgaacgcaacttatcattgtatgcgttaaaatcatgaatgattccaacttttaaggaggtgcctctcccattaattgggttcctagcatgagaaaactgtctgatgaattactaatagaatcttatttcaaagccaccgaaatgaatttaaaccgtgactttatcgagttaattgaaaacgaaataaaaagaagatcgctcggacatattatttccgtatcttcttaataggaatttgtctattttttccgggcgtatttcctttttttactcagatgactgatattatatcactttggctgcgcgctttactactattttcagcaaaaaacacccctaaaaagaggtgttttaaagggccggttattatgctaaccagtatatgccgcccacaacaaggagaacaacaactaaaacaacaataaaagcgtatccatatgctctgcctgcgccatacatgtgaagcgcctccttaataaggttttataacagcctatgtaggagaaataaatcggactaggcggttgtccggctcaacgctgcaggatctgcccatcttgtattccttcatatacgatccttgcccctttaggtgtcatatgatttccagaaggatctataagaccagattggataagcgcttcatcagttgcttttccgccgtctgcttctataaaatgcttccagttatctacaagagggacatccaggcgcttcgacacatctcttgtaatatcgttatatgagttgtgccatttccttgctccgccttttggttcaaaagcagctgcttgatatctggaatagtaaaacaaatgatgcttcccattaccttctataattgggatacacgtcattaagattggcttgatcccgtgttttctgctttcttcaataaaataaaccagattttctctaaaacgctgcttcgacactctcggtttcccctcagtcagtatggcagcgtcattggtgccgaacataataaacaaatacttcggtttttgatccagcacatctgtctgaaatcggagacgggcatcctctgtcgtctgtccgccgattcccgcattgagtatatcaaggttaccgcgctcagctgtttttaatatattgacccactgctgtgcttttggataatcgcgataatcccaattagagccacgcgtattgctgtcaccaaatgctacaacgtcttcgtatccccttccctcgcatcctgctgtaacgaacagcagaaggaaaaggatgataaaatgtttcatctttacacccccaaaagcctcaccttaatgttatacctctgtttctcttcgttcaatgaagagtttttcgctatcactgttttttcctatagttaacgtgtccccctcagtgaatatcattctgctttcattgcggcgcagctgatgattttttaaaattcccttctttccaatctgaaaaacacacaaaccaaagaaaagaaaataacctaaatccgcactggaaacaggttatccgttaaatcctgcatttactttaacttcgatttaagcttggcctttgtttttggcccataaatcccgtctgcagttaatccgttcatgagctgaaaacgcttgacggcattcgctgttttcggtccgtaaactccatctatgccattgtttttggctcccttatcagggtaaaagtgaagtgcagttaaagccttttgcagctggagaatgtttgtgccctttcgataaggcgaagtgagctttataaccccagacggcagaggatatgatggtaaaggttcttttggaggtgtatccgaggaagaaattccgtttataaaagagttccagtggttcaagagtttccgcggacattctttcccagaccattttttgtggggaacaacacgatgtaacggaatattgttttccttcatcagctttctgatcagccactgggcatttgatgttgctttttcaaaatcgccatcagcattttcgcagatttcaatcccgatcgatttgcggtttcctgtcccgtttgtaccgtctcccgcatgccagccgttttcatctatcgggagatgctgataaatgactgaatcgtcaactgtaaaatgccagctttcggatgtgctcgggttttttacaaaattggcgtgcattttcgcatcagcgccttttgctgtattcgctgtattatgcaccgtaatataagcaggcgtcatcgcatagccaggacgattatcatttgataccggtataaaatccttttttatggttaccatttctatccctccctattattaagaatgcagaaaacagagagatggacagccttttttatgaggtaaaaaagaattgtgttctcaacctggttttcagttgaaccgctgaaatggcaccagttatactaatttagatgacggaggttttggctcctgacatcacctaagttgggagtgaccatagacatgttaaaaaaagtaataggtatacttgtgattatcgctatcattgcagtcggtttttttcagaaagaagcttggcttgatgcaatcaaagcaggagggatgttttccgttttatttagtatgctgctgattgctgccgatgtttttttcccaatagtgccgtttgctttggttgctgctttaaatggcgcagtgttcgggactgcaaatggaatttggattacactgaccggctcaatgcttggtacaatattgctgttttttctcgccaggtacagttttagagattgggccagaaaaaaagttcaggcctatcctgccatacaaagctacgaggcttccttcaacaaaaacgcttttaccgctgttttattaggaaggctgatacctgtcataccttcacttgtaatgaacgtgatctgcgggctgagccaggttcgctggcatgtttttttctttgcgtctttaatagggaaaatccccaatattgttgttgtcactattgcaggtgccaatttcaccagcaataaattattgtctatcagcatttacggtgcatatattctgatcatcatgctggtcatttataaaaagttccctcatcttctgaaggtgccaaaaaaataaggaggcttgttggcccccttactttttttctgtcgcatggcctccaaattcatttcgaagcgcagcgaccacctttcctgtaaacgtatcgtctgttaaagaacggtatctcatcatcagtgacatggcgatgaccggagttgccgtctgcagatcaagcgcggtttccaccgtccattttccttcacctgaggaatgcataatgcccttgatctgatccagtttcgcatccttagcgaaagctcgctcagtcagtcccataagccaagaacgaatgacagaaccatgattccacactctggcaaccttctcgtagtcaaaatcaaattggctgttttcaagcacttcgaatccttcaccaatcgcggccatcattccatactcaattccattatggatcatttttaaaaaatgtccgcttcccgcttcaccagcgtatagataaccattttcgacggcagtatcacgaaaaagcggttccacaatctcccatgcttcatgatcgcccccaccataaaacaggctccatgccgtgcgccttccattccgcccgacgttccggcatcgagataatggatacccgcttctttcatttgattgtagcggcgaattgattctttataatgagagtttccagcttcgataatcatatcgcctttacttaataaaggtgatacatcacgcaaaacagcatcgacaatgccatgcggtaccataacccataggatacgcggcgggtctaataaagaaattaactctttaagattcgttgtcccctcagccccgtatgctttcagttcatcaacagccgcttgatttacatcatatccaaccgcttgatgattgcggtcaatgaattgctttcctatgtttatgcccattttccctaagccgattaatccaattttcatatctgttcctcctgattgtctaaaaagcctttactctttatgttccctttggattgtattgtgatacgcagaaaacaaatggggcttacatcgtctgcgcatgtaaattttatttttcatgactgactgtgcctgccagttctattactgaatctctttatatccataattatcactttatccttgatttaccatcagtttaagttaaaatatgggaaggtattcgatttttttagtaaaaagaaggtgacatgttgcagaatcaatctcatactcttatcggagttacgaaaaccgctgtattctttttatacgctgcacttgcaatcatcggttttgcaatcgggtattttattccgcagattgcgaaatgggcattatccctcccctggatccctcttgaaggaccacttcggctcattacctcttttcagggatctacagcttcatttatcactgctcttctcggtatgtgtgcggggatttggttcgctcattctgttattgcaatgctgctgtctgtcaaaattacagatcacacagtggaattcatcaaaggaaaaaaagtgcaaacaattcattccgatgacatcgctcttgtatttatggatcacaaacggcttgtcctcctgggaacagccggatatgaattggtacgggaagaaattgatgaaaaaccagtaaacgttgagaaggcctttagacagcatcattacgaatgggcaacagatggtgatccgtttaaagatcaatttcgccgatggattcctgatgcaccagacctatcgcaaggcgcccatgccttattaaaagctcgtcacaaagcactgcaggacgaagaaaaagacgatattgaagaattccgtctcgaactggcacagctgggcatcgttgtacgggacgaaggcacacgccaatattggcgaaaagcagaaacctatcccccgaaaattcagctcggcgaaggattgtaacaacagaggctcaagaaagagcctcttctttattactgcacaataaacagcactctggtgccgtcagggtagctgctcatttgattccctacccacgagccggcgccgcgattatcagaaggcgtcacatatcggacatcagcccctgcaccgccttcctcgcagaccgccatcggccactcatcccggtcatagcccggcttggtcgggattccctttaaagattcctcccgccttttgtctgctccatctctgtcaatggtacaaatatctggatgtccctctgcaatcgcatccctaatatgactgccggtttccggataacgagacagcggaaaatataacactttgtcatacgaagatgcgccttggatctgttgcggaaccattaaacaaagaagaactgctgcagcaagaaacaggcctgccatccattttttcattcccatccccccatacctttgttcatttcaatgtatgggcgcttgatgaagaatatttttaacatttgaagttagtatgctgcttaccaaagccggactcccccgcgagaaatttcccggtacagacacagacagcctcccggtcacatacatttacatataggcttttgcctacatacttttgtggaggtgacgatggtgacaggtgttttcgcagcgctcggctttgttgttaaagagcttgtctttttagtatcttacgtgaaaaacaatgcctttccacaaccgctctcaagcagcgaagaaaaaaaatacttagagctcatggctaaaggggatgaacatgccagaaacatgctgattgagcataatcttcgcttggtcgcccatattgtgaaaaaatttgaaaatacaggtgaggatgcagaggacttaatctccatcggaacgatcgggctgataaaaggaattgaaagctattccgctggtaaagggacaaagctggcgacgtatgctgcgaggtgtattgaaaatgagattgtaattacaaaagggggtgcatactcctctttaatacgtttaaatatattcggtgatctcttctcctctcttggtttattattgaaacggaaacaaaaatccattacactattgctgatgcaccaacgggtgggaggactcgccatgaacaaaaaagaactgctcctaatgaatttcaaggacttgtttaacaagatggcttggcttaataagccaaagatggaagtctgtcttaaagggtataagccttctgaagtacattgtatagaatccattgaacatggaaatactaatgtgacaaaactagctgagtccctttatatgacgagggggccataagtaaaatgactaaaaagcttatagaaaaaggcttaattgaaagctaccagaagccagataacaagaaagaaattcattttaggcttaccgagcaagggaaaaaaatttataaaatccatgatgaactgcacaaagagtttctagagcgcgacaaggcagtatttgaacaagtaaccgaggaacaatttgactttatgattaactttgcggaaaagtataatagacatttggatgtagaaataaaaaaacaaggttttgatattaagtcggaataaatttaaataatgaaaatgcaaccacaggcagccaactctattgagtttcggctgcctttttattaccgtcattttgttgacgaggaaacaaaattatgttattttttgttgactgggaaacaaaaaatacaacttttgagaggtgaataatatgttaaaagacaaagtaaaggagccaggattaccaaaagaaatcctcatggcttcctgggccattgcacttggagcaattgccccaatgcttgactcaactatggtgaacattgccatcgacaaattaaataaggatttcagtacgacgttggataccattcaatggtccattacaggttatgttttagctcttgctattgcagttccagtatccggatggcttatgaacaaatttaatggaaagaaaatcttaatcggcgcagtcattgcctttggtgtaacttctgtttttgctggaattagttgggatgtttctagctttatcttattccgtttgcttcaaggatttagcgctgggattattactccgctcatgtcaacactcttggttaaaacagcaggtccagagaatataggaaaagttatggctatcgtcagcacacctatgattttgggcccaatcttaggacctgtaatcgggggcttcatcgttcaagctacatcatggcattggattttcttcatcaacgtgttcatcgttttgattgctgcaccactgatgatgaaaactcttccagactttgagccattcaacaaaaatagtaaacttgatatttttggaattatcaatctatccttaatgagtgcagcaatgatatacggaattacaaaagcagcagaccatgcatcatttaacaatagcgaaacaatcctatgggtgggcatcggcctctctttagctgtaatttacatcgtatataatcgaatcagaaaaaatcaaaccgtactccctttaaatttgtttgcacacaagaacttcttagcatccagcgtcgggttattattagcgaatattgccgtcatgggacccatgttaatacttccattgttctttcaaaacttccgtcatttcacggcaatcgaagctgcgcttgcattaatccctcaaggagttgggatgctcgttactcggccaatgattggaaaaatgattgataagatcggtgcaaaatacgtggttattgtcagtctcgtcctttcgcttatcggatctattccgcttatctttatcaccgataaaacaagtatgatttggatttctatcatattattcatccgcgggaccagttttggaggaattatgcttccgttaacaagtgatgcttatacaggacttgacagcaaacaacttccagaagcaggtgtcggtattaatattattgaaaacctcggtgcaagttttggttcagctgttatcgcaactgttgtcgcaactactatacaaggattgcaaccaacgattgcgaatggcttaaaaggttaccatgccggattcttagtatccaccattgtccttgcggtaatcttcatcccaagtctatttctcacacataaaaagaatgcacaataaagaaatctgcatactcgactgccgaacggtttgtttggataacttgtgatacatgtgatgtgcaccagtttcataagcccatttagaaaggcgcttactaatttgattggctatctgttttcttcgatgtctggatctacttcagaggtttcaattacaaaaagagggcaataaccctctttaatacgtttcaatatatatagtgtcagaatccacaacggtaacttctttcacgataaagttaacaattgtttttttatcatcaagggttaagttatctgcaccgattgattgaaaatagtcgatggctctttttagagcattttcacttgagctcgtatcatccaggactttcatttttgattgaatttcgctacacttttcagtaagctggttttgctttttttgcagctcaataatttgcgctttgatttcatctatgtctaaatcatcgtcatcgcttaggctgattagcgttaaaagacgcttgcggcctttttttgttttctctatctctttttgaataagttctaattcatcagacaggtgatttgattgttcaatctctttgaaagaagcatacttttgaggatttgtgatgaatttaaaaatttcaccccatacatgccggttcaatttattctcagacatttcctttccgcagccgcggtcctttgcgccagaataatttttccggcaagtatatacatagtagtctttaccatgtgattttcttttcttccctgtcatggtatttccgcatttcccgcatctaaccaaacccgataacaagtaattgtgagggctaatgcttaagtgttttcttttactttgacctaagagttcttgagcataatcccattgttcagctggaacaattgctggaattgccacagtgatttgctcctcttcaggccttattttgattatagatttgttccctgcctgttttgaaacataggaaccctctgtatcatatttatactgtttatgttcacccttataagaagagttcattaatatctgtcgaacaacctgcctgtgccatactttggcacctttttttgttttaacccccatctgagttaaatgtagagcaataccatttactctgccgaaaaaagggcttttatgatcggtgaaatagttaaaaatcatcctaatgatttttgcttcctcttcaaaaatctcaagagttcttttctctttaacaaatttatagccatatagtttggaatctttaataatcatgccttttttcattttttgaagtcggccgcttgatgtccgttctttgattttggctttttcaaattctgagattgctccacgcattgcgaaaaataattgaccttctggagaattggcgtattcaccatttacaaataccaagggtatatttcgctttcgcaattcgtcatcaatgataagctgattcattaatttccgagaaagacggtcaggatcataacaaatgacttgacttataagtcccttgcttgcatcctccctcaagcgattcaaagccggacgttctaaaagctccccagaaaatccttcatcggcatacttcagcacatccttagtccctgctttctttatacaggcctcgatctggctgtcgatgctcgatcccttgatcgcttgttcctcggtcgatacccttacatatattgctatcaccctggatctccttcctataaagttttattaaataatgatagcaatcgttaatgcatttgtcagcttgcggtccctcgatgattatcaccttcataaaatgcatcaccccttgggtaatgctatgtaaaggcggtttgtcctaatgaaatcattttcaatgagtgtgaaaaaagcacttaaaaaaccgatagttaaaacgatcggtttttcgacatcgcctaggccctcaacatagtaaattcatatcattagttatgaaagcttattttcactacactccttatatttaattgccatcatttctatacgatttatatgaaatatggtaaaaaatggttagctaaaacgataaagataccaacctgttcatttggtatccccattcttcaagtacctcaataaatgtaaaccactgaatatttttatgacattgcacgtgtcaatgatgccaattcatgaactcataaaggagatttaataaaactcccaaaacaaaagggatatcaatatagttggtatcttctttattagtttgaatccctcaataaagtggatgcttatcataattacaaaaaactttatttgaagcactgaagtcattcattatattgttgtaaagataacactatagtccccttcttacttcataaacggttgttatatttaacttcttaattaagggacattttctgtttttagattcgttatgtctttttctgttacgtaaagaatggagataaaccaatagaattaagtgagctttaaatgcttcaaaaagctctgataacaaatctctttataatattcatgtgaatttatatcttcactcattagccattgaatgagcaatccatctacaatagatcgcattgtttttgaagctttttcaacatctatactttggtcaaatacgcctgtttcctgtccgaaaataataatgttagatgtggtgccccagcactgttgataaaagctatggttaattttcctgtacgtttcatttcgggttgcctgagacaagaaatctaaataaaccttataaaacttttcattttcctcgggagagacaaatattgaatttacataagctttcaacttatctagtggcgtagattccgaatccactgcttccaattcatgtttataaattttatttgtaagccactcaagtagttgagaaagggtatcttccttattatcaaagtaataatgcacgacgcccttactaactcctgcgtgatctgcaatactttgtagtgtaactgaattataaccttgtgttgacacagcttggaaagctgcccttaatatctgattctttctttcttctgcttttttcttcataataaacctccagaaagctaaaccttcaattagtatacaacagttcatgaaatccacacaaaattattccgaccagacaaaatagtttgaccggtcagaataatttagtatactaaaagtggtttcacatcaagatagcatataggaggatttataaaatgaaagacgaattcaaggctctagttgtaaacaaagttgatgatgaattttcaattaaagtaaagaatgtttctccagcgtttttaccagaaagtgatgtccacatccaagtacactactctggaattaactacaaagatggacttgcagggaaccccaatgggaaaatcgtaagaaaatacccatttataccgggtatagatttagcaggtgtagtcatttcttctaatgatcctcgctttaaagagggggataaggtgattgccacaagttatgatataggtgtttctcattttggcggttttagcgaatatgcaagtctccctggagactggattgtacctttacctgataatttgaccctcaaagaagcaatgatagtaggaacagctggcttcacagcggcactatctattcaacgtctagaagaaaataacctatctcccgaaaaaggaaaagttctggtaacaggagcaacaggtggcgttggtagttttgctgtttcattccttaactctctcggttatcaagtagaagctagtacaggtaaagaatcagaatatgattacttacgaaaacttggagctagtacaattatttcacgggatatgacctatggagggaaggttaaagccttaggatcacaaaaatgggcggcagctgttgatcctgtaggcggggaacctcttgcctctatcttaagccaaattcaatatggaggttccgttgctgttagtggattaacagctggaacaaaactgccaactactgtttttccattcatcttaagaggtgttaatttacttggaattgattctgtatattgtccaatggaaacacggttaaaaacatgggatcgtgtagcaacagattttaaaccatctaatttaaaggaatttatatcacaagaaattactttagatcaacttcctaacgttcttcctgaaatattggaaggacaagtaagagggagaacgattgtaaatatcgtatgattattcatcagaactcatccagttgctaaagatgaaacaatgtcttaaaggtctagtaaagggattctcaacaggaattcctttacttattatagcttactttatgttaatgcaaaaatataaggagtgatcctccccattcagcttacacagtcttaatgatatgaaaacgcttattcatcgtacattataaatgtggctcctagtctggagtttcgttatgggcaaacaaaactcaaataaataggaacccaccttgtcacaataaactcaatagactaatgctgagaagtctccttacttacttcaacatgctcaaaaccctgtaaacaggttcccttggggagaagaaacatttgaaaaagcgaaacgcgaaaacaaacctgttctcgtatctattgggtatagctagctcgggtagctatacgcacatgtcattggtgccatgtttcttaaaataaccacaaaaggcaaccagtttcggctgccttttaataattttattggaaatttttagaaagctagattcaaaaactttttctcttctaatttaaatactgttgttttttcttttgattcattccattttatcttgccctctaatttgtgtcacttaatatcttcctcgggcatataatcaaaagttgaaacgtgattggtttttttcccaccgtctacaaaccgcgagttctgctgattaagaaatggaaagataaaaagctagatcaaatcatagaaacaccttattattgcctttcaaaatcctctgcataaatgaactcaactttttgactgctctcttcgtattccccttaaaatttaataatcactttcccttttggccgtccatttgcgactagttctagcgcttcatttacgttgtctatggtaaatagtgttggatgaattgctggaacaatgttgttttcttcaatgattttagtaatctctttaagttgtgcaccgtcagaacgaacgaagataaaatagtatcctacgttttgtttcttggctttgcgatcatactttgcgcccgcaagggaaaatagcatttgtttccacaatggaaaatttcggtcttttccgaagcgtttatttggtcctgtacggagagagagcaatcttccgcccgatttgatgatactcaattcactgtcaaattctttaggtcccagtgtatcaatcacgtaatccacattcgacaacaagtcaacatagttttctgttgtataatccaaatattggtctgcacccatttccaaagtgcgttcgcgcgcctctgagctgccgctaacaatgacatttaggcccattgcctttgcgattggtacagccatttgaccaaagctgcctgatccacctggaatgaagacagatttacctggctgtgcctcaagttcttcatgcaggccttgatacgctgtgagtccagccagtggtgcagcagcggcttccacgtaagacaaattttttggcatgggtgcaattgcggcagcgtcaattgcggcatattccgcaaaagcaccaattttttcgagggggagacgtgtatagatggcatctcctacgtgaaattctgttacattttttccgactttttcgataactcctgtcaattcattaccaagcgttaatgggaattcataatcttgaatcagtttcacgctgcctgtaattattaacatttctagtggattgactgccgcagctttgacctttaccaagacttcgttttcatcgatttctggaattggaatgtcattgactttggcatggatattttttgaatacttggtgatctgagctgctttcatgagtgttttcatatttttatcagcatcctctatcatattacatttattaggtttttacctttttatataatcgtttaggtggaggggaatcttactttaagcgaagtctgacttccaattttatgattaacccgccacctaaacattcgtgatttttagaacgatcattctcaaatgattaaattttttaggtccgatactgtaaataaatgtttctcatcttcctagtgttattgatatagaacatcgttattatatagatttaataacttgaaagattacatctctagaatcggatagatttgatctcttaattgaaattcatagttttcgtctacaattcctactacttgattactatcataaagctccatcataaaactcgccacttgctcaactgtgtggtacatcgggatatttgctttgtaatcaaattctgtcgtatcagatgcatttttcatgaattctgtttccgtgattgctggtgctaaaactttcaccttcattttcgcacctttgcgttccagttcttttgcaagcccttctgtaaatgcactaacaaagtatttagatgcagaataagtaatactgccaacagcaattgcatatccgagggctgatgatacgttaattaactgagttccctctacatccgaataatcacgtacaaatagtgtagaaagaattgttaaggattctacgttgacacgtaacatggtttccactttatctaaattctgatccgtgacagaagaagattcaccaagcccggcattattaatccaagtctcaatttgatattcctttaaattatcatacagtgtgtatgcctgagctgtgacagataagtcacatgtacgaatcataacatccaaatcgggattaatattctgaattgttgatttaagctcttctaatttatctaatcttctagctacaataattaagtttttgccgcgagcagctaacgctaatgctgtctcatatcctatacctgagcttgctcctgtaataactgtatacttcatattattctctcctcgaaaacaaatttttttttattagatcatccatataacaaaatagattcagtctaatgtcgacaaagtcaaatcaataatgttttctaatttttcctcatcatttgtcgtttttgctaatactcgtatccctacgagtgaattatgaataaattgagaaagccctttgatatcatagtgtttagaaatttctccttgttcttgaccatgtttcagtagatcaaataagaaggtttctgtctttataaaagtctctgtaacttttttagtaaacgatttattccattacgagatcttggctagatgacagatcataatcaactgccactacactcctggtcaccctcaattaggtcaatgccctgttctttgctgtgtggatctgaccatacgggtcaccattttgcgcggcatcaaccgtggaaggaatgccatgaatcggtttcgagccccgggcattattaacgtcttgccacgtaagaagcctcggtacccttcctcagccacctgcccggcctccatgatagcaccactctggaacaacttcgattcaccaatacccgaacgatcaacgaagccggttgacgtcagtcccggacatagagccgtcacagtcacccctgtaccgctcagttcgttctccaaagcctcggtgaacgacagcacgtacgccttcgttgcgtagtaaaccgacatcataggtcccgggaagaaagccaccaacgaagccacattcatcacgcctccttggccccgtttgaccatatccggcaagaacagtttcgtcataacagtcagagccttgatattgacgtcaatcatattcgtctcttgttctaactgcgtctccaagaacgtcccgtacaaaccgaagccggcattattgacaagatagtcgacgacgatccccttctccttgagctccgcaaaaatctcctccggcacaccgggtgacgccacatccttggcgatgaccgtcgcttgactgccatatcttttccgatattccttcgcgagctccaaaagcttaccctcgctacgcgccaccagcaccaaattatatcctcccttggcgaaacgatccgccaactctttgccaatcccacccgataccccggtgataagaacagtttttttcatttgacagcacacctccatttttagtttgaacttttaaaacgttttacagcgtttcttactgcgagtttttactatggatgtatgttatccataattcaaatttttgtatcaagaggatttatacttgccgcatatatctcaactaagacctcgccattatttattttgggcctagggaagtaaaaatttggtttttcgccgtagttttcaatcgctaaagctttcgttacaatcctccacatttttatttaacgcacatgtatcttttcctaacgaacctaagaaaaaagaatatgaatatcccttccctagatgggatattcatattaaataaattattttaagaaaggataatctgtataaccttcttttcctcctgcatagagcgtgttttgatcaggttcgtttaggggagcacctgatttaatccgttctgcaaagtctggattagctagtacccaagtgcctactgtgacaacatctgcaagattattatctacatcagacgaaagttgatctagaggacgacctggacggttaacaagaagtgcttgatcccaaagttgacgcacatcttttaggaattgctcgtttccaaagtgcattaaatgcagatatacaaggttaagcttatttaattcacttattaaatagcgatacatctcaaggctattttccccttcatcaatgccttgcagtgttccttgaggagaaaaacggatgcctgttctttctgctcctatttcatcaacaactgctttagctacttcaattgcgaatcgagaacgcccctcaatcgtaccaccgtatgcatcttgacgatgattggagttttcactaaggaattgttggatcagataaccattcgctccgtgaatttcaactccgtctgcaccagcttcaattgctgaacgtgctgctaaacgaaactcattgataacatcttttatctcaagctcactcagttctcttggtgttgggacttctttcattccttctgccgtgaaaatttctacaccaggtgcaatagctgacggtgcaactgcttggcggtggtgaggtgtgttatcagggtgtgatatacgtcccacatgcataagctgaataaaaatatgaccgccttcactatgaactttagaagttacttttttccaccctctaatatgattttctgtataaataccaggtgtattagtgtaaccttgcccatcatctgaaggttgggttccttcgcttataattaaaccgactgaagcacgctgaccatagtactctgctactaaatcgctcggcgtaccatctggtaaagctctatttctagtcatcggagccatacctatacgatttttcaagtcaatgtttccaatacgaactttttcaaataatctgctcatatgaatactcctttttaataaaaattagaatcaagaaataaatttacgtgttctgcaaatagttctggaaattgaaacagatgcccgtgaccagaatcaggatatataatcagctgtgctttgggtaatttctctgctaagatgtaactgtttttagttggtaccattacatcattaacaccattagtaacaagtacagggtgtttgatgttttgtaaccattcataatcatgattagatttttgtttagcccattttgcaatggcttgtaattgtgcctcttttacttgttctgaactgtttacttttttctgattaaaaattctttgtagtgaagccattcctgcagatttacttgtttcggtttgtgcgtagaaaaagaacataaaatcatttattccatcttcttccgttccgccgtgacgattcattctttcaaaaatctctggatttggattaataccagattcaggcgaagtacctgccataataatttttcttactaaatctccttcttgtaaagctagctcttgtgcaaccataccaccaatggaaaaaccaagaatgtcaacttgttctaatccaagagcttttataaatgttgctgtatcttttgccatatcagtaattgtagtaggcgttattccatctgtctcaccaacccctttattgtcaaataagattactgggcgtttatttgcaatcggttcaagcatgtctggatcccagttttccatcgttcctctaaagtgaacaagaaatactagcggtataccatcttgtgtaccaaattttctatatgcgtaacgagttccatctgcttcaataaattctgattctgatggtattttaaagtttgtcatttttgtgttcctccttagaaattaaaaaacgattttataagtatgcattatgatggtttgtttcatgctaattttagaatgaacgttctaaatagggtaaaaaaaagaaagctagtccaacactgaaagtgctagagtaatgatgccttctaattcttttttactgtaattagtttttattagtactcttatacctaccaaattgttgtgtaagaaacgagatatgttatcagaatcgatttcttttgatatctctccactagtttggccccgttttataaggttattaaacatatcttcagtacggttaaacatttttgtaactatgcgtccaatttctttgtccaacaaagataattcaatggctgcatttactgatagacaaccttttgggtattgttcaatggaattcagtacgaaaataaaaacatcacgtatcgcctgtttaatggatgaagttctgctaattatgctttccatctcattgacgacgagctcttcatagtgattaagggaagctaaaaacaatgaacgcttgtcaccaaatgtgtcatatatactcctgcggtgtatccccatatgatttaccaaatcttgcatggatgttttttcataaccctgttcccagaaaagctccattgcttttcttaatactgctttttcgtcaaactctttacttctagccatttttttctccttaaaaaaatcaatgaaccaatactaacaaaaacaaaagtcataatccattgtagaatgaacattctaaaatgaactcatgaatttcaaaccatgattaaataatatcctttttagaacgataagtaaagaattataaatttaattatcaataatctctggaacaatgtgcattctcatttgagtagcaaaacagttagatctaacgtgtttcaagtatagcaaatttgagaacgatcggtaaagaatttataattaatcatgtgttttatatggctatgcgtagcctgaatttttatgaatatcgttccattttatctctactcaaatcagttctgcaatgtcactggtggcataggatcttttttatattagatgcacacaacaacttcatccaaatacaaaaaacgaatgggaactatatactagttgtttttttatttacagtctaaacaaagtaaaggaagtattacttgaataacttcttttctccaaacgatagctagccttggcctattctaaagaacattgtcatttttgcaaattaggaaactaatttatcatagctagccttcaattaaacgttttaacttaaactcagtttcagtatcctcaactggagtatagacgctgcatcttaaatcagtatccccatgcacttgtaatgaagtaagattaaacaacattttacctaccttagcatgacgaaactcaattaatacttcaggagcagagcttatctcattttcgttccaaattttacgaaactcaggatatgcctgttccatttcttgtataaattgctcataccagtcgtcagccacatactgtccataatacgttctaaatattgcgatatatcctctaacaaaatgctcccaattcactgctaaacttttaaattcctttcttgcgaataataagcgtattatattcctttctgccgggatgatttgttcaaaatccaaaaatacattagctgctgcttgattccatccaacaatctgacttcttctatctgatataatcgttgggcaataacgcagttcctgcaaaatttttactaaagccgggctgatttccttctcattctcatttctaaaaggttgtttcactccttcctctaatgctagagcatacaaatatctcctttcatcgttatttaattgtaatgctctagaaatagcatctaataccgaagtagatacttttatatctctaccttgttccaaccatgtataccatgtaagacttacaccagctaattgagccacttcttctcttcttaatcctggtgttcttctgcgggttcctacaggtaaaccaaccatttgaggagtaattttcgaacgttggttctttagaaattctgataaagcttgaagtcttgtttcaggtttcattaagatctccctttaaaatagtattaattatactaggataaacaacaacttgtaataggataacacaatagctaaagttaataaaaacaaggagggaattatcatgaaaagagttgtcattactggaatgggagttatttctccactaggaaatgatgtaaatagcttttggaatcaactagttaaaggacactcgggaatatctctaattgattcttttgatactgctttttataaaacaaagatagctggaatcgttcgtgatttcgatgcagatgaaatattggggagaaaagaagcaaaacgattagatcgttttagtcagtttgccttagcagcagccgaacaagcattagaacattcacaattacagttagataaggttgatcttgaacgtttaggggtatatgttggttcaggaatcggaggcatacaatcgcttgttgataatgtgaatgtattgaataaacgaggtcccgcgagagtaagccctagccttgtaccaatgatgatttcaaatgcagctgcggcccaaataagcataaaattaggagcacaaggaccatcattatcaccagtcacagcctgttcaatcgggaacacctctattggtgaagctttcaatgctatccgaaatgatgaagcagatattatatttgccggtggagcagaagctgcaatcacacagatttctttggctagttttggaaacgcccatgcactatctacaagaaaccaagatccaagtcgggccagccgtccgttcgatacagatagagatggctttgttatgagtgaaggcgcaggtatcttagtattagaatcattagaaaacgctattcttagagatgcgccgatattatgtgaagtagtggggtacggagctagttcagatgctcatcatatggtagcatcacacccagaaggtaagggtgcctacttggcaatgaaaaaggcattgagaagtgcaaatatatcaacaggtgaaattgatgttattagtgctcatgcaacaagtacacaggtaggtgatcgttcagaagttctagctattaagaaattgtttggtgaacattcccgcaaaattccaacaactgcaaacaaatccatgactggtcacatgcttggtgctgctggcggagtagaagcaattgctttagtggaaagtttgagacgaggaattattccgccaactattaatgtagagaagcaagatccagattgcaacttagatgttgtatcagaagcaagacaccttccattgaaatatgggctatcaaattcttttggttttggaggacataattcagcaatcttgttaaagcattacgattgaagacccatctttatagttcaaaggtgaaataatgaatctatcaagggtttatagcccttgattttcattatggaatacctcacagacaaatgatgacgggcctcagctatctggtatattaaatagaggaaagagaatacttaaaaaaacatttagaaagaaggtgatcccatgccaaataaaagtaaccccaatagattaatcaatgagaaatcaccatacttactccaacatgcccaaaaccccgtagactggtatccctggggaaaagaagccttcgaaaaagcaaaacgtgaaaacaagccggttcttgtcagcatcggctattcaacctgtcattggtgtcaagttcgtatagctacacattatttaaaaaaggacacatataaatatgcatccttacctttttattaacagcaagagttcgttgtactatcacttggtggtgttacacaacaagaggaggaatcttgtttttgattctcgctgttcgatttggtatagaaaaattcccattcattcctatttgggtcagtaatccaaaatttatcttggactgcataacaacaagttgtatccatttcttcacgtgcaaaaacccctctttttcaagcctttccttgtgtttcaaaacttcttccaaactatctacttggaatccaaaatgattcacttgatttcccgtcacctcgtctacgacatttaaagtgaagttcaatccaggagtctctaatagaaacttagcatagtctgtttttactttcacagcctttactccaaatactttttcataaaaatcgatcgatttctccaaactgacaacgttaacccctacatgaacatatttcattttaattccccctctaatatattaatcaaaaaaatttgatttaatgactaaaaattttttagcaacaatctccttcacctttttttctaaatacacaacaaagctcttctgataataaactatttacttcctcatcatttaaatcataatagctccatgttccctttgtctctttcgttattaagttggcatctaataaaattttaagatgataagaaagtttagattgtgttacctcaaaaatctcagtcagatcacaaacacaggtttttcccctttgacaaagttcatacatgatctctaatcgtttctgatcagcaagagccttaaatttttgttcatatttccgaagtagttctgatttcgtctcatccattcatatcgccttctttaatcaattttttttgattaattatgaaacccactaaaagctagtgtaaccagatagaggttttctatttttaatattttcctccatcgctactacaacaaggttacaacttgcttttggtggcaagtcatgaacacctaaaggagaggagatttaattaatctaaagcaaaaaatacaccaatatgatttggtatcttcatctaaatcgagtccctcaacatagtaaatcttcatctacaaaatactttcattacttaacatatatttaagttccttaatacgcaaaaaagttattgcggtctcaccgaaaatttaaattgcggtgccctattgcctttttctgcgaaagaaaacttgttaatatttacattactagtagagttaagggaagggtgaatatcttgatatcaatcacatcagctgaagtgggaatgaagattaatgaatggcataggcatattcaaaaattcaatgttacggatgctgaaatgttaaaggctgaaatagaacgtgatatagaggttatggaagaagatcaagacttgcttatttattatcaactaatggcctttcgacataaaatcatgctggagtatactctgccatctgatgaaaatcgaattgaactttcagaatatttaaagaaaatcgaagggcataagaagaagctagacaatatgcgagcgtattattataacttcttccgcgggatgtatgagtttagaaacggtgaatacacaaaggccattacatattacaaaaaagctgaacgcaaaattccaacgatctccgacaagattgaaaaagctgagttttattttaagttatccgaagtctattatcatatgaaaatgactcacatctcaatgcactacgctgaactttcatacaacatctataaaaaacatgaactttattctgttcggcgtattcagtgccattttgttattgctggcaactacgatgaccttgaaaatcatgaaaaagctctcccccaccttcaagaagctttaaaaggtgccgagctgcttaaaagtaaaaatactcacatctacgccacagcatttttcaatctcggtaactgctatcacaaaatggacaacttaaataaagctgcacgttatatcgagcaggccttggttcaatacagaaaaataaactctgacgtacttccgcaagcttatcacgacctagcgttgatttattttaaacaaggcaaaaaagaacaagcaatggattgcttccgcaaaggaatcagaagtgctgtagattttaaagacgaactttttatgaacttatttgaagcattagacgttctttatataagaaatggcgatacacctaaactcctcaacattttttctcgtttagagaacggcaaaggatacccttatctggaagagctggcattgttaggaggcaaccttttcgattataatggaaaaatagaggatagtatcatctgtttcaagaagatggtatatgctcaaaagcaaatatcgaaaggggaatgcatgtatgaaatctaaattgtttatcagtttatccgccgttttaattggacttgcctttttcggatctatgtctaatggcgaaatgaaggaagcatcccggaatgtaactctagcacctactcatgaattccttgtttgattcgataaacaacattagttctgattccctttagccgtttcataacggctttttcttattttagacatgaaaagcatttcacaaaagctggtcaaacccaaaaactagaactagatcaaaagacacagatcgaatgattcatttccaccctttgatccacataatacttagtttcatcattcttccatggtaatattttgttatataattaaatgagagggtatgaatatgaaagtctttgaagctaaaacacttatgtctgaagctacagaccgcgccaaagaatataaagaactaaggacgcaaatggtcaacttgagaaaagctttacaaagcgtcgctgaactggacgacagcgagttctcaggtaaaggcgctaataacattaaagcattctatcacgatcatgttggtgtcactgatcaatggatcgactacattgacatgaaaatcgcattctttaacagcattgccggagctgtcgaggacaagggcctctctgatgcttatattgaagagtcttttttagaacatgaactggctaacgcccataaaaaatcaaaatccatcatgtctgaacagaaaaaagccatgaaagatatcctaaacgatattgacgacatccttccgctcgacctattttcaacagaaaccttcaaggatgagcttgcagatgccaatgacaaacgcaaaaaaacaattgaaaaactaggtgatcttgacgaagatttactgacagaatatgctatgtcagaaccaaatgaacaattcatcaagtcagacttccaaaagctccaagaagcaacgggcaaaggcaaaaacgctactcccattcactacaacgccaaggcgtaccgtgagagtgatatacataagaaaaaaggcgatattgagaagcgaacggaagcttatttgacgattaagaaagaggaagcgaaggaacgcgagataaaagacttaaagaaaaagcttgcgaatggtgtctcagatccggatgagtatttagaaattgcgaagaagatcgggtatgagaaccttgaacctgcacagttacagtatgtggtgcagctagaacaagcaaaacagctgaagtccgtcggtgaaagtgtaatcaatgcgggtaaaacggcattggatatcatcgatggggttaatgatgggcttaacgatgcgattgatgatacgatatatggcatcaaggacttggttgtaggcgcatgggaattttcacagctccctatggaactaaaacttgcaaaaacaatcacaacagtcttaagtgtcccctcctaccctaaaataatttggacaaacatcgtcgattcatggaatgataaaatgataaatggcaatgcatatacaagagcacattatatcagttatgcggtcggtaatatcgttggtccaaaaggtgcaggtgctgcagtgcaaaccactactaagctctcaaaagtgggtaaagtggttgaaggtggaacagctactgctcatgtcaataaagggataaaccaaggcaaagcttacattaattctattgttagaaataagaatgatcttgcacttgtcgggattgcccaagacatcgataatacgtataatgcaaagaatacgcctttattaaaaaggattattgaagataaaaaagagagtgtacttagaaaatccgagacgtctaacaacatgggtataggtaatgtcaaacaaggtgatagtacccctctcgcacctggtggaggattagctgctcatgaggcaaaaggcgggcatcttatagaaagacatgttgggaagaccgacgaagaactaattcaaagacttgataagagcaaaatgagtaacaagaagatatccggttcatcatcatttaaagatagagcaactgcagaaagagttgctaatagtgctctcacaaataataaagcgaaaatagaaaaatggttaaatagtgatgtgaaaaagcctttagtactctcttataaagggaatgaagttttaggaagaggaataccaaagggagaagatacaattactgatttaactaatgctaaaattatattgaaaaagaacaaagatggtagctttatattaactggctacccaacgaggtgataccatgatagatacaaacatttccgaacctgtttttcaatttctaggaggtatttttcatcaagatatagaaactccagaatcagcactggacgaatacttagaagagattccaaaagaagagcaagaaactgatatagtagcattaaaagattttattaacagtgattatacggatgaagaaaagaatgattttatcgatgaagctgctgacggagtagacattcgtagttacggagtatctccattagtatggctcgaacaagttattcaaaaaatagaaaagaacattgaaactttataatccataaaaggtcccttgaaaattcaagggaccttttattacttcaaaagccctttaatttttgctttcgttttcggtccataaatgccatcaggatttagtccattcatcagctggaaccgtcttacggcatctgctgtttttgggccatacacaccgtcaattccattattcttagctcctttatccgggtagaagtatagtgcagccagtgctttttgaatttgccttacgtcgtctccttttctcatcgggcttgtcactttatagatgccggaaggcagcgcatatgacgttttcttgctgcttaattttgttgttttctttttagctgtacatgttttacttgtgcttgttttcccacctagcgcttttaattctttttcaatggcaaccttaacttgattccatcttccctctgacaaaatacggtgcgggcaatacttaccgttccagtcttggtgcttacggacacgatcaatgccccatccgcgttctttaagtagctgcgccacaaacttaatagcaagattttccgctgccttatatcgcgcccctcctgacttgctataacaaatttcgacaccaatcgacttacgattgcctgtaccgtttgttccatctcctgtgtgccaagcgttacgattcgttggaattccttgaatgacttgtttatcgtctactgcaaagtgaaaactcgttgagctagagttattcttcatgtaagaaatctcattggctgctgaagcatcattcgcagtgttatggatagtgatatactcagctttcattgggttaggacatttcaatccatattttgatttagaaactaaattctttacaactttgatggccatatatcctctctccttctgtctgtgtaataaaaaaagccactggcttagccagcagctctgtcagcgttattcttactctgttctttttcgttctccattgtttgtaatcgatctgttattgttgatgggattttaacaccgatctgtgctaagttttcagttattgacaatccttcattagcgacagcttcctgacgcacgtaggtaaaatatccctatgtgtgtcgtacacctctctgataacaagtgcagttcgtttttcttgaagcaatttcagtacaattttgagtgccacatgatagcttttggatgatccataaccacccacaagaaactgaaacttttgattccaatcaaagagaaattctttaaaatgtgggtttacttgtttaatcatttgtcatcactcttgtttacaatggtgatctcaaaaggtttatcttcttctgtaagttcttcagtctctaatttcttcttgtctatacttaaacgcatatgctctaatttaaggcgtcgttcgtcttccgagtgggctaattcatcaaactgtttaataaagttcctgagctctgccattgccctagattgagcgttcaagaacgttgcatgaggatcccaagaaaattggaattcatactcttcctcttcgccttcgttcacctcagataggatagtctttttctttttcagttccttaatcatttcctgcttatcagaaacgaacatgattttttgcgctcttataattgcggcatattgaatctgaatttggtcccatatcatatcaacaggggatcgctcctgtattccttccatgatcgatagcgtttcttctggcaggaacttagagaagaatccatgagtcacagcgttttgatttctcagtggagctgcaccacctttatttcctaatgcatttttatttccaagcggtgctcttcctcccttatttccttttgcatttttgttccctttaggtgcgcctcgacgcaaaagagcgctccctttcgatttaggagcgctcccttttattttttcttcccatttatcgtttgctttccattttcggacagtgctacttgttacgtttaattgctcagcaatgtcttttaacttcttactcccgccgctctcttcccacaaacgaaaagctttgtctctgcgtggatctcgtggtcttggcattacatcttacccacctccggatctcatgtttgagtttgtgtttgttttaatagtttttttctgatgtgtctactactgcacctttagacaaaatattcattttttcttatttagacttaaatctatgtcgaaaattattgtttgacatatcttatactaactccactaaaagaggtgataacatgtcaaatggttacaatagctccttcgtgttagttgtggtgttgttcatcctgttaatcattgtgggtgcttcattcctttattagtcttgaaatattttaatctactattaaaggaggtaactatatgggatactcgaatggttatggtagcactttcgcattaatcgtagtgctattcatcctgttaatcattgttggtgctacattcctttattagtctttaggcactttaatccaaagcggccttttggatttcacctccctgtacgaagacgccataagaagtttttatggcgttttgctatgttattaacaacacctttaaattgtcaaaataggatagacaataaaagagaggccactttaaaacctctctttttaattaattgttttcggaaatccttaacaacaaggttttccgcagtacttatgatgctcagtgacaggatcgtaacttgagtaactatgcggaaagtaatgaacatgctcataatgttgatgattcacgctagttgtatgctgcggatgaatgtgaggaacaattgtatttgagaacgtatgatgttcacaacacttagtcggatgcaaaattggaggtaaaattttgcaatgatgcatattttcttctcccttcattattttttatctgttataaactatgttcagaagcatctaatagtactattacaaccacctatttactgctccatgaggatttatcaaacaaaatcatgcacatcacaacaaaagctgtatagattacttattagagcaactctccactccacataaataccccatcgctctgccccacgtttctccaactctttatgatcaacgtggggttttattatgaaaagcgctcctcaatatgaatagaacccatttttcttggaaataatcctcctacgaacgaatgcacccgttattagtgaattcgctctaaaagcctcgtttgatagagcccattcaacccttatcatcatcaaacatgaggctttattttgtttttgtcgggaatattaatttttacgcaatactgctggtgttttatcacccgaattcactgtataaaacctcccagttgagttgatcctcgcttatcgctggggggttttctcattccatgaatgtagtggtgacgcaggaataattcgccgcgccgacctgcctcccattttacactacagattttttcggattcaacaagcgctcaaagtggcaatcttggcataattggctgatcaactcgtctttcattttgcgtacagtttcccttgaaatgccaagatgaagacctattgcacgataactcatcccctccatcatgcaatcataaataactttgtgctgctcccctttgatcttttctgcccccaactcaactgcatatactcgttcctcatagtacttaagacgtttgaaaagacgttcctctctcatatccatttgctgcaattctgcctgactcttcccgggacttccttttggcatagctgcttctaatccatattgtgcaacgccccaatttttcattgggattactgaaccatagagcactctctgcaatcgatgaacctcttttgccatccagtgatagctattgattagattttcaatatcttttcgattcatgattgtgttctccttttccaaataaaaaacggacaccaaacaaacagtgtaatactgtaagtttagtgtccgcaggctttccgtcttggacttaagtattgtttttttctattttaatctcgataggtttatcatataaatcttctttcttcttgatcatagttttactgcataaattgtggttactttcatttcctaataaaagatattctctatttatcgaatgtaatatataccatgtttcttttccatcttttatgtaaactttcgtagttttattaaaattaaatattggttttaaaagggctggaatatagcaagaaaaatatacagagataaaaaatgcaacaattttttgagtatttgtctcaaattgaaaagacaaaattaaaccattgagtccagtataaaaatacaaaaggattattaaatatattattgcaataaagatttttagaggtttacccttaatcttttctatgaagatgtaaagtaataaaaatatggacactaacattataccagctatacttatccaccttataatctcaagccaattaaagttgggattataacttgaaataagctgagctattgagacaaaaccgagcgtccagatcaaaacagaaatacaatatatccccaaccttataattaataattgttccttggagtaaaactttttttcaacaatacttgaagaaaacatagtgactggattccccgctcttataagttgtactattaaaaatccaactgcacttattgcaccaggaaaccctaaagaggctaataattgtttaaaagtatcttcgattttaatcaccactcttaaatttcatagttattccattttaccaatttacgctctccttctcaacgcctattattagacgtatcgggtagtaaaaagttgattaatcacctggttttaaattcaaggggataacaactgttggttaattttattatgctacacaaaaaaataattgatcaaatgctttttacctcaccttaaatcctatctcatgatcaactcttgcaaagctcccctttacagtttgaataacagtcttaccgtgctcaggagcatctaagacatgagcagttccctgattcccatctaaaacaatgatctgaacttttcctgggtcaattttctgctgaatagtgaagtcttttttgacgttaatttctcttggattgtacactcaaagcgccccctatgttatgatagaagtaccagttcatatcaagaacactgaggctaagcgcttcggtgttttttatttttaggcagaaacctcttttatcatgatttccaccctcggctcttcgctataaaacttactgactttcaaatccaccacctgattatcatctttgtatatcaactgattcaaagcactttcacaccctttacatagttatcaacatcaggctttgtagtaggccgcaaaagaccattttcagctttctctttctttttttttgagtttgaaactgacttaggcattggtctgtacactttgaaacaggaccagtaataattgtttctggtcgatgctgagacgcaaccaaagctacatactgcttaaaatactttgatttcgctggatttcgcatatgcaccttcccatttctcgtattgatccacgcggctgtccttgtgcgactggctcaccataaacagtgaacttaatgcaatacaactgttctttacctcccgtcaagctgttcccatagctcaatttctttttctattctcggtgcggagagtaaaattgccaacagagacacgactgctttaagcactcagcatccgctccatttgctttattttttcctcaagtaaacggattgttggtgtaagatctttaccttcagttggatttgaaggtccaaatatataaagtccaccaattactttcacattcgtttcctccttcattcccaatcaccttacctatgatttaattgcattcgatcgcctttaataatcactatgtaatcacgacacatctggtgaattcgtgaaccaagagcctcgtctatatccaaaatctcatcgactgttaactcagaagaaatcagcaaaggcttatgattcaaataacgataatttaagactgactggatttgttcaacctgccaatcggttgcccttggctgactgtttattggtttgaataagtcatcaatgaataggacttcgacctttctcatgacatcgagttttacaactaagttgtcaagttatgccagcaatacttatgataatcttctggaatcatggtacttgcaaggaaagaaaaaatgggctcttaaatccgtttaaatctaaacacaaaagaaccgcaactggcggttcttttagtatatattcctatttgacttcattattattggacagtaccataatcaaaatcaatatctttcttgtctaaatccccctcaaaatttttagcataagtcattgttaaatgtacgcttttatctatccaccaagttccatcatcagtattagtatcccaagtaacatctatatctcttcccaaattctcaaaaaacaccaaatttccaacagctactgtttttccgttgattttgtaatatattagaacaattttcttatcaaatatacctgtcccgtgctttacgattgttaaactataaggcttattaggacattgctcttcaagtataacttcaggatttaaaaataaaacataacaaatgaatagaattggtacaatcgttaacctttttaatacttttttattgatatttaacctcttcaacatagtcctccctttttaacaatccatttcatttgggatacaccctcatcattgaaggtatttcctatgaaaaatgattttgaagctcataggaacccttacatgacagggtttttgttgttttttcattgtctattaagatctaaatcaaaaaaagctataaaaaataaggaatgatacatattatacatgactaatatgtatcactcctttagtttttgttcaataatcgcccccgatagtgggataagaaatagcaaaagaacttgctatttctcaaatacatccaccaaatgttcaatgttagtttgtttttcatacatactaataataaaagtaaaaccttattaaaactttacaacacaaactgaatcgactatagtctaattagactaaaatattgatgtaaagaagggaaaaattagatgataaagtcttttttaatgttggggcagtcgaatatggccggccgtggatttttgaatgaagtagacccgatctataatgaaaaaataaaaatgttgcgcaatggacagtggcagatgatgacagagccgattaattacgaccgtccggtctccggcgttggcctggcggcatcttttgcagatgcttggtcgaaagctcatcctgatgaagaaattggcttgatcccttgtgccgaaggtggcagttcattgaatgactggcatccggaaggcatcctttttcagcatgctttgtccgaagcccgcttcgccctccggtccagtcaaatttgtggaatcctttggcaccaaggtgagagtgacagttatcgttcgctacatgaaacttattacgagaaattaactcttatcatcgagacactaagaaacgagttggaacttgatgaggtaccgttgattattggagggcttggtgactttcttggaaagaccggttttggacagcacgcgactgaatttcgacaggttaatgaacaattgctgcgttttgctaatgaacaacagaattgttattttgttactgcagcaggtttgactgcgaatcctgatggcattcatttagacgcagcttcacaacgcaaattcggttaccgctatttcgaggctttttcgaaaaagtaccatatcctgaaacccatttcgggagaggagcaatcgctgaaagtgaatggtgactattctaaaacagaacagatttaccttcatagtatggatttggcttcgggtaaaatcacgtacgcggaatttgaggcgcggatggcgaaggtgatgaaaccatgattcccttacttatccttggcttgctaatccaaaaccccggagctcacggctatgaacttttggccttaatggaaaaacgtcattacaaatacattgttaacttcacgaaaggttcattttattacaatctgcagcagcttgaagaaaagtgttttattgaacagattgagcagaaaccctcaaccagcgggcgtgaaatccgtaactacaaagtcacagattcgggaagggcagaattcgaaaaattaatgatcaaatacggcgccaaatcggaatatgtgaacctgcaattttatggggcgttactctttgcagatgaattcgacaaaaataaattactggatctgatccaatcacaaatcgatcagactaaaactcgaatcgagctccttgatgaatacctgtccatcactcaagaaattcccggcacaatcgattactttcgccgtatgaacgaaaattcccgttcacatcacttggttaatttagagtggtttgaaaaattgaaagcagaaatagaatcaactattgcagaataaaaaaatgcaaagttaaaaataagaatattagttacctacatataaaacctgtgtcgtagatatttagtaacatcttttatacaggttttatactccttctttaattaaacaagtaatagggttgtcagcacttgcccccaacaagagcaagtgaatcagctccgtgttcttcttttcaatcgctagccgttagtttaattagaattcaaataatccaagacgcggtgaactctttcgctgactgagcaatcgccttcaatttttaacactggacaagataaatctgccatccaatgatcatgcaaagctctacttctgacttccattccagcagtatcatataaagaagcccactctaaaaatgcttttgattgttcatatttactgccaccggctaacacttcatttccataacgctgaaattccctatgccttaatctctcaagccgtatatcttgtggaatccataagaagacgacaaggtcaaaataactttttagattatcgccccagccacacactgcaccagaaagaatccatttctcatttattgttaagtctttttcaagcaactttcgtctttcaggaatttctctttttttagtgaatttatctaaccaatagtaatcatcggtatcaagatgcgtatgaggcaaatgctttgataatgcagcacccaatgttgacgttccgaccccagaggctcccaatatgtgaatattttttttcatacttccccctccttattaagcaaccaaactccctgttgcataaggtacttactattattttgacataaatccctaaagacctttacttttctagagaaatccagatgcgtgttaaaatcatcatacttacgaaaacagtcattattaaacggattcatattccatctcctcagatgcattttcctatgaaaaaagtcttgatttccctataatatttaaacgaatccaatttttagattgtcgtctttaaggaggtttttcatcttgaggtatacaaacagtcatttagaggattggattgaaaacttatacagaaagattgatattacagagcctgaacaaattaattttgaacggattgccgaggctttagatattaggctgtcgtttaaacctgttacaagcttcgcacttaaacacagcggaatttataatatatgcttggacagccgtaaaagccgaactgaacaatggtatgattttgctcatgaattttgccatatatatagacatgaaggcgataaaaaaacaatgcctgcaacctggactgattatttagagtggcagtccaattattttacatatcacttttgcattccaactttcatgttgcgtaatattaatctttcgtacatacaatcccatgcaattgaaaatgtagcttggttatttaaggtgtccccttcattcgctaagaaacgtttaagcatttattacaggaagctgactcaacatttatttaatcaaacagttacgggaaatctgtgcaccccccttttgtaattaataatgaaatcctcatgcatttgcgcgcattgaaaaaaacaaaaaaagacgtctcccttcacgatccgatcgggcaggataaggaagggaatgaaataagcctgattgacgttttgaaatcagaaaacgaagacgtgatagatacgatccagctcaatatggagcttgaaaaagtgaaacaatacattgacattttagatgaccgtgagaaagaagtgattgtcgggcggtttggacttgatttgaagaaggaaaaaacgcagcgagagattgccaaagaactcggtatctcacgcagctatgtatcgcggattgaaaaacgggcgctgatgaagatgtttcatgagttttatcgggcagagaaggaaaagcggaagaaggcgaaggggaaataatgcagaagaagccggatctcatactccggctttctctatttcattaaagtttttttaaaaagaaaatagagaaaaaatatataaaagagtgatgaaaatcagttttgtcatcactgataaactcttcgagaaaagcgtctggatcatagcagatggcttctctcttatggggcgttacttccctccatcaagcgattctaagccggacgttctaaaagctctcctgagaaaatccttagatcggtatacttcagtacattcctagtcactgctttctttatagaggcctcatctatgctgtcgatacccttacatatatgactatcacaatgagaggacttttaatgaatatgaagaatcagttaaaaaacattggttagaagcagttcattttaaagaactactcattttatttcttcttcaattaaatcactggcgtttaagtacaattcttcacaatctcttctgttgactccaatccctaagtagtgctcctccagtacggtgacacatatagagggacgagaaaatctcatttaaactgcccatccgatggcgggcagtttaattattacctctcctgttcctttatcaccctctcaatcccatataaaatcagtttcaagccaaactcaaatgctctgtcagtccccatcaactcaaacagcccgttcgtaaacatcctccggaataatcccgcatctgtctcgctcatggaatcaagaaggcgtatcatctcctcccccggatgctcttcttggtccttcaggatagcagtgacattgcgctcatgctgataatcgtctaaaacgaagtagaagacatagtttacaagcgtagtaaccacttgcattttctgctcttgcttaagtggtgttgattccacgcagagtaacattcggttcgtgaatcggatgatgtccggttcatggggcagcgtcatcatcatgagctgcgtagagcaaggatatcggctgagcacgttccgtaccgttatcgcaagccccatcagctgctccttccagtctccctcggagtggaactcctccagaatcattttcgatacttggttagccagacgctggtaaagcttctgtttgctcttgaaataccagtacagagagggagcctgaatccctagcctgttggccaatcgtctcatgctgaatgtttcgatgcctccctccccaagaagttcccacgaggtttctaaaatcttttcctctgaaatctgaggctgctgctttttcatattatccgtccttttatctaacagtgtaagtttctctttacaggtttataaaatgatgataccatctaacactgtaagactcaaactaacagtgttagattaaatataaacaagaaagaagtgaaatataatggatacagaaaacctctattattttgaaaaagcaccgatcgcaaaagctgttgctcacttcgctataccgatgatgctaggtacatcaatgagtgtcatatattccattctaaatgcctttttccttggtacactccacaataccgccatattaaccgcactcgcattaaccttgccgttatttgcaatcattatggcgctaggcaacttgattggcatgggcagcggtacattcatctcccgtttgctcggggagaaaaaatatgatgatgtaaagcatgtatcctcatttgccttttacagcagtttagttcttggtcttattgtgatggcagtgggtctccctttaatcgatccaattgttcatggcctgggggcaacatctgactccttcggcttcacgaaggactatgtcatggttatgcttattggttcacctttcgtcgtattatttttcacgctggagaatatcgtgcgctcagagggttcagcaatcacgtcgatgaccggtatgattctcagtgttgttgtaaatattatgcttgatgcgttagtcatcttcgtatgccattggggtgtaatcggagttgcgtctgctaccgtcatttccaacttggctgcgagttcattctatgccttccacatgggatataagagccagttcttaactgtctccgtaaagtggttcaaggttggcctggatattctgagcaatgtattaaaaatcggcattccggtctttattatgagtatttttttgggggcaatgtctcttatctttaatcattttcttgtcgaatatggggacaaagccgttgctgcatacggaatttcatcccgcttatttcaatttcctgaatttattttgatgggactatgtgaaggggtcgtaccgttaattgcattctcttttacagcggataaattacgcatgaaaaataccattggatttacattaaaagcgattgtgacgctagcagtaatgtttggcgttatcgtctatttaatttccgaccatctaataggtttatttacaaatgacccgcaattaattaaaataggcagctacattctacatgttacgtttttatccatatttattacagggatgtcctcattatttactggtatcttccaagctaccgcgcaaggaacggccgcttttgttatgtcatttatacaaggaattactctgattcctgtattgttcatcgccaatcaggtgaacggctttcatggggtggtttggtcacttgtcattgcagatacagtcgcattccttgtaggtgccatcatgctttatgctttgaggaacaaattgcagcctgaattgaatagttaagtgctagtaaacatatgacatttaaatccgtattgtaaactaatcaaatatgtaaaaaaagatagtttagccctcataatcggctaaactatccccttctcaaatcctcccactttattattaatgtggtttagaagaattgaacctgcacgagttattccgctcactatcattgattatgaagcttatatattaaaaaatggtgagctcaaaacagtaaacgtcgggcttttttactctcttccttttaaatacacgattagaatcatcaaaaacaataatgatatttacacaaattgcgatttacgcaaaagtcaccactcctcttttcatggacagaaaaagaggagcaaacctatgtctgcgtcttaacgtttttctttgcacaacgtctagtatcttctttggatcaatttttctgtaagaaattcaacaagtgttactcaacgacatgaagaaattgtttatgtccttgtcatttcagttattcaactattggtgtaagtgaactaccagcccatacctctcccttattaagggtccagctgtcattataaaaattagacccacctttattaaccgaagggctgtgaacctcatcccaagttagaaagtacacggttttcggatatttttgtttgactgtattaagaaacacagcataatccaaattaccatcttgtttttgtgtgccgatttctgtgaacgcaaatggcttattaagagctgttaactcatcatatccttgaattgtaaaatcatctgagaaatacgcatctaatccaacaatatcaacatatgaagatccaggataaaagtcagtcttaaagtctcgattggcgtccggtgagtaaacccatatcaggttgtccaaacctcttgtatcagtcatataatgatagattttttgataaagttgtttataaagtgagaagcgctggctgtcttttttgttatattcggttagtccccaccaaaaccattctccattcatttcatgaagaggtctgaatagaacaggtacaccttcattttttaactgatcaaggccatctgcaactttgctcagaacagcctctaatcgcttaccctctgtagttgatgagtctaagattttttcatactcactgtttgaaatatgggaagcatttttcccaaaagtactggatgcaggattagctagatgtaagctaatctgtggtattccaccacttttccaatatgagattaagtcactgttgcaactatagtcgatcgtctcagtaatatcagaaatatagggcttctccaaccatccactggaatagtcacaaccataaattgcgggtaactggcctgtagcattcttaattcggttggcttctttcatggaaaacgaagcatttgtgaatccgccgaatgtacctgacagtatgcgattttcagatcggtttggcagatgagccagccaattcatcaactctttcgttgttgcctgtgcattaggattcacagggtaaactgtatgagcaagagccgactgtgaaaaagatgaaaggattatgaaagatagtaatataaaaacagcaatttttttatacataatattctccgtcttctactttttattattttaatcatttattctgttaaagatttataaagcacagaatctattaagtcatttacgctttttcatcccctttcatatttaaaataagagagaccttccttagagatatttgcatttacccattgtaaatctccattttttgggcattaattatattaaaccgaaaaatatcttctttcatcagacgtttcacctattttttactgtatgcctcacagactataaagcaaactttcccttttgcatttaaaccttattacctatttcattaagtcgaattattttcgatattaagtggtgaatgattttcactctcttttttatcctattaaattattttaaaaaataatcaaaaaacaaatcattttgatccctattcatagcagcaaacgttacttttggtacaaagtcctttataaacagaaagaggagcaaacgtatggtttactcctctaacttagtttctttcttcttggtttttcataatctgatgttttccttaacagcagttccaacccgtcactttctccgcagcatataatcaagattctaataccaatccaaaagttattttgatctactgagaattttaatttgcggtgccctattgcctttttctctctctgactcatagttttaaaccattcaataaaaaaccctcaattgatgtttcatattcatttgattttcaaaaacttcagccgtatcaacctgttaatcttacccgctgacttatatcaaaggagctctaaccaaattttaatggctgtcgaacttattaatagcgctaaaatccattgcaggaattttgtatttactttttgcccaactgatgcgccaataggagaagcaattaaactagcaatcataagaaccagggctggtacaaaaagaacctggcccgtaattacttttccaactgttgcgccaatagatgaaagaaatgtaatcgcaagagatgaagcgactgtgattctaacaggaatatttaaaatcgataacataatggggactaggataaaggcgccgccagctcctaaaatacctgatacgccaccaatgataaacgctagggacgaagccaaccatttattaaatatcacttcttcgccttctctatgggcttgtcctcttttaggtataaacattaaaataactgctataatagccagaattccgtatataaagttaattcctttttcagatatataatgagaaaagtaactccccaatacactccctaaaaggatgctgcttcccatgtaaattattaatgctttatttagaagaccactcttacgataagcccaaacaccgccaagtgtcgcaaagaaaacttgaatagcccctatccctgaaacttcatgggcagttaatgacatcactctcactaaagagggaatatacaacagcattggataattaataactgctccgccaataccaatcattccggaaataaaggcaccaataaaccctataatgaaaagagttgtgataaaggcaatatccactttggtttcctcctatcaaaggaaaagggtatctttctattcgataccctttcacattcattagcctttttgaatccaaaatttcaatacatcgccctcgtccgtttgctctaaaaggtcatgtccgcctgatttagaccaggctgcaagatcatttttagctcccttatctgttgcatgcacttctaatatttgacctgattccagttcattcatcgctttttttgtcctgacgattggcattgggcatgccaggccttttgcgtctaatactttatctgatttcatgttcatctctcctcttattaatagaaacttgtgttaccgtattgcacagcggtttgggccaatctccatttcacgctgtttttcttcatctgggctgattttccccatgtttgtttctcgaatctcttggtatgcatttggttgcggaggcaaatgatctgttactaggtgtctaaattctgtttcatccgcaatgttcaaaccatggttctcgctaaataatgtacttagttttttaccaacacttccatcctcatttagctcgtcaatgatcataaagtgtgccggtaatacaattaaatcctttgataacgctttgtaacggctataaagcgtttttcttaaatctcctacccaatcttctgccataccggctaagtctggtctgccgattgaatcaataaacaaaatatcacctgaaagaagatacagatcatcgacaatgaaagaagtggacccaatcgtgtgtcccggagaataaatcggttgaattttaatcgttgtatttccaatgatcatgtcgtttccttcttccaacggctgataatcgaataccacttcttcagcatctttaggcggtaaccagtaggttgcttttgttttttcagcaatgactctgccgcctgaaatatggtccgcgtgaagatgtgtatcaaatacgtgagtaatcgttgcacccttctccttcgcaaaatccataaagaaatctaccatacgtgtcgcatcaataattgctgcttcaccattggaaatgaccatgtatgacaggcagcctttaccgattcgaacaaactgatacatctcaccgccatcttttaaatccccgacttttaccggctctaaatgttcgctccatgctttcattccacccttaagataggatacagaatgacctgcttcagatagcatttcggataccatgacggatgaaccttcttttgcacaaacgaccagcacttctttatcagaaggaattttctccaatatatcttctacgccatctaaaagatcaaaataaggaacattcaaatggtcaaagtcatgcccttctatcttccaatcattaaaatcattttcattacgcacatccaaaataaataaaggttctttgttatagattttttttgtcacttcttttggggtcattgcctttacggtcatgtttcaatacctcctatatcaaatcttttagcggaactaaaacgttaaggatacatcagcatctttaacaaaattctaaaaaggtaacagccccgcctacttcgattccttgtataaattcatcttttgttaaacccataacgtccatcgttatttgacaaccaattcatgcaactcccatttcaatcagttaagaatagaaggcacatttgcgttcctacaaccttctgcgacatgctcttttccttgtcgcaatattacagactttataagcatcaaacagaccgccatttgccgcaataatcgctactcttgtactcatctgttcatcatgctttttatttattcggttttacctgtccactcccgcataccggggacaacattaataacttttttaaaaccttgttttttcatggtgtgggccgccatttcacttcttcttcccgaatggcagataatataaatttcatcatttttgtttaattcattagagcgcttttccacttcaccaagagggatatgcacaactccaggaatatgagctttttcatactcctctatctctcgtacatctaaaatgttaagagactcgtcactatccactttctgtttgaaagcttctaatgaaatatcaggaattgaagatgcattttctgatgaatgctctcctccttttcgaagaaaatgacgaagtatttctccctctgcttcagtacctagatattcatggcctgtactttttgcccatgcttccagatctgctgtggaacctttatctgttgcttgaatttccaatacttcaccagcttttaaatccttcattctcttcttcgtttttacgataggcattggacacgccaaacctttagcgtctagtacaatagttgctttcatcattttttcctccttttttcatataggggtgggggtatataaatatacaaaaagtttctcactagaagttaataccatgtattcatgcccccttttatatttgtgatgtttttaaatccttgtttcttcaatatttttacttgcctttaaacttctcattccgcttagcaatgagtaaatgagtagcattagataaataagttgacactgccttcctcagcatctgccaaataagctgctacaccagcatagtcgatatcatctaatagttctttttcctgtaaaccaagaagatccattgtcatcgtacaagctacgagctttaccccctgttcttgagccatctcaatcaactgaggtaatgtaagtgcattatgctttttcatcacatttttaatcattttagggcccatacctgcaaagttcattttagataaacccatcttatcagcaccacgaggcatcatctttccaaacattttttcaagaaatccttttttcactggaatcagctcttctttacgtaaagcgtttaatccccaaaaagtatggaagatcgtcacttcatgatcgtaggcagctgcaccatttgcaataatataggctgccattgccttatcataatccccgctaaataaaacaattgttgtgcgttttgtttgttctgtcatgtttattcccccaactaattacccctgtgggtatattaaagtcaaaaaaattttttcgaaagatctgcttttattcaactctttaaataccatagggggtataatataacgcatataaaaattcgtcaaccttaggttgatgaatttttatcggctctttaccaataagtcaactgcttcttttactaaattttgtgtgtcttcgcctttttctaaactttcacgaacacaatgttcaaggtttgtgctcacaattaaacccatcgctcgatcgatcgcattacgggaagctgctaattgggtcacaacctctctacaatcttttccttgttccatcatagtcaatacacctttaatttgtccttcaatccgtcgtaagcggtttttaatcttttgatcatactccatatatcaatgaaatcctttctttcatttatttttacatttacatgctgccagttcataactgtttacatggatacctttgcgctttagaaaacgcactcctaaatttaattccacccgatcacgagctattatgtgtattttatcacgtggaatctctaaataaaaacgttttagatacgcatatgggatgtttaaaataatattatccgaaaaattggctacatcgttataatgacgaatatctaatattgtgatgtccatagcctctaatttatctttatggatacaagagattccggttataggataataccgtctatacgatgcaatgataatcacaaaaataagcaggaatgcaataactaaataattgatactacttacaccaccttattaactctttgttattcacaaaactataatatacccccataggtatatagtcaagtgtgaaagttactttctttgagctgatagattcatttcaatatccgcggattgaaaaaatacttacatttcgataatgccaattctgctaaaagtaactcgaataaagaaataagccgattttattttaaatcgactttattttatcaattacttttaaaattagcacaagactgcttggatattacattgggtttcatttgcataaaaacaattcttaggtactggttccccatgtttcatgctggatgtgactccaattactcagaaatctgcgaataactatgctaatcttccgcagccactgcatctgctttggttttatgaactgtaccaaatggatggttaggaggagcataaatggagtaaagttttaatggcgtattacctgtattaatcacgttatgccaagtgccggcaggtacaacaatggcagaatcatcataaacatttctttgaaagttcaaatgatctttgctctttcccattttgacaaccccacgcccctgctcaatccgtaagaactggtcaacgttaggatggatttccaacccaatgtcttctccaataccaagactcatcaaagtaacttgaaaatgctttcctgtccataaagcagtacggaacgtattgttttgttttgtggctctattgatatttacaacaaatggttttggtccataatcctttaaaagaagatttctatcttcatatgaagagcgcaaatcggcacctctgtgtacgttctccatctcatttggaatagtccaataaacagatcttccatcattatacatcggtacagtcacataataataacattgaggcgaaaaagggttatagtacattttttgatccccacaattataaatttttgtgatagtatcctatgcatttattaagggagtgtgctaaatcaagaaaaatcatattaaacacaaaaatgaatgttcgatcaccgtttgattcacggatgaataatttatcaccgaccttgtaatcgttttctggatgttgaatttcactagcctttgttaacaagacatcgaatgacacttttatatcatggattatcaaaggtcgacgatcctaaatggcttttgaacatttacatagcacaacaacagagtatacggaattctgttgtttgtcccccctatcccagctcttttagatttatccctttggatgcgccttgatggccagcttttcagcagcgtagtatttagcgcctcctgaatcgttatagcatatttcaacgccgataaacttgcggttcccagtgccgtttgtaccgtcacctgtatgtgggctcgtttttagtaaaccagtttatattctttttgggcacacaatagaagcaatttttcatatgaaaatttcgtaatcttacacctctttaacttgaaggaggatttttgcatatgtattttcatacccgtcaactaccatctcatccagcatatattcctcatatgcattttcccctatttgcattccattcttttcaatgaactcaatgattctccggtacgcctcttcagtatttccgcctatttcatatccaactgcatacaggccttttggccgtacatgataatttatgttctctcccccattttttacttttatataaaagtaactgtaattgtagaagtctttttctaagatttgttcccgtgcaaagattccgcctatcggatatccttcatctaattcatattgctgaacttcatgaatgagttctgaaatggctgccacatattttcgttccggtaagtttaatgtttttcggcttaacatgaatgtttcttcatttaaatattcaaaagaaattgaggaaaaatcagtctcaagtgcttgttctgtaagcgtcacttttgtttgtaagatcgtttgcaactgcttaagctcatttatttttttatcaatctcaatagacttttcttttagaacatgcaggatcttgtctggtgtttttccttttattagacactttatttcttttaatggaaccccaagctctttaaatagactgatgacttgaaaaatctcaaattgatgataggaataatatctatacccattttctttttttatttccggcgagaaaagaccaatctcatcataatgaaataaggtttgtttttttacacggcagagcttcgaaaactcccctgttgtgaaatacttcttaacatcttcgctcataaaaacctccttgactatacggtaaccatataccttatgatttgattgtacttgaaaaaagcttcaagcgaaaaggataggtaaaaagggttcaattgagtaaaaggggaattcagatgaaaaaatcaataaatgagcaaaaaacgatattcattatactattaagcaacatcttcgtagcatttcttggtatcggtttaatcattccagtaatgccttcttttatgaaaatcatgcatttatccggcagcacaatgggttatcttgttgcggcttttgccatttctcagttaattacttcaccttttgcaggtaggtgggttgaccgtttcgggagaaaaaaaatgattattctcgggttgcttatattcagtttatctgagttgattttcggattagggacccatgtttcaatattttatttctcgaggatattgggtggtgtaagtgcggcttttatcatgcccgcggtaacagcatatgtagctgatattacaaccctaaaggaaaggtcaaaggctatggggtatgtttctgctgcaattagcacaggctttattattgggcctggtgcgggaggatttattgccggctttggcatccgcatgccgtttttcttcgcctccgccatcgcgttaatagcagctgtcacttctgtttttatactaaaagagtcattgtcgatagaagaacgccatcaactctcatctcatacaaaggaatcaaatttcattaaagacttgaagagatccattcatcctgtctatttcattgcatttattatcgtctttgtaatggcttttggtttatcagcttatgaaacggtattcagcttgttttctgatcataaatttggcttcacaccaaaagatattgcagccattattacgattagctccattgttgcggtagttattcaagttttacttttcgggaaattggtcaacaaacttggagagaaaagaatgattcagctgtgcttaataaccggtgcgatcttggctttcgtgtctactgttatgtcaggatttttaactgttttgcttgtaacttgttttatttttctggcgttcgatttgctacgtccggccttaaccgctcatttatccaatatggccggtaaccagcagggtttcgtagcaggcatgaactccacatacaccagcctgggaaatatatttggacctgctctaggcggtatactatttgatcttaacattcattatcctttcctttttgcaggtttcgttatgattgtcggccttggtcttacaatggtttggaaagaaaaaaagaatgatgctgcagctttgaattaattcattttctataaagtcaagtcatttggatgcagggaatgcccctggttaggcacaataagaaaaggtacttaatttgataggctacatgttgcttgacgtgaatatagtttaagctgagttttagcaatatcaggataccgggataagaaaaaaggagaatgtagtatgagtataaaaataaaaggagtaactgatgataatcgtgctgcaattcttgatctacatgtcagccagaatcaattatcatatattgaatctacaaaaatatgtttagaggatgcaaacgaatgtcactattataaacctgtcgggctttactatgaaggagatctagtcggttttgcaatgtatggattgtttcccgagtatgatgaagataataaaaacggacgagtctggcttgaccgattttttattgacgaacgctatcagggaaaaggattagggaagaaaatgcttaaagccctcattcagcaccttgctgagctatataaatgcaaaagaatttatttaagtatatttgaaaataatattcatgctatacgcctttatcaaaggtttggttttcaatttaatggtgaactcgactttaatggtgagaaggtaatggtaaaagagctatagatatccaggcctccttttttgctgagaaacgtttgaacttcgataatgattacctacttaaactgcaagatcattgtttaaaaaagcctggatgaaaatttcatctcaggctttaagcatcttattagtcaaaatctcatgtgttttatccagatgttattcttttttccggacaatttctaaataattaatatgccggccaactgttttgtgcactttaaaaatatacccatcggcttctataacggacccaactgcagcgtctatttgttgagtcataaaccagccgcctattgtatccacttcgtcacttgctaacgtcgttcccaataaatcatttacatcttcaatgagcactttcgaatctaagatatagtgattatcatttacttttctaatattaggcacttcatctttatcaaattcatctctgatttccccgacaatttcttcaagaatatcttcagcagtgactaaacctgaagtgccgccatattcatccacaagaatagcgatatgtgttcgctctttttgcatttttaccaataaatcatgaattggaacggattcaataacatggataacagggttgatatgattttctaacttgaaatcctcttttatcttctggtctgtgtcaatataagctgacaaaaattctttagcattgataaaaccaatgattgaatctttatctccatttaggactgggtaccttgtatagctctctgtcttaatggtcttaacaatagtttcataagaatcctcactagaaatcgctacgatctctcttctcggaatcataatttctttggcgattctttcatcaaattcaaaaatattatttacatatttcaactcattttgattgatttcaccgctcttatagctttcagacagtaagatgcgcagttcttcttcagaatgagcaagttcatgttctgatgcaggtttcaaaccgaagagtcctactataaaccgggctgaaccatttaaaaaccatataaaagggaacaggatgcggtaaaaccaaataattggctttgcagtcaaaagagtgatggtttccgctttttggatagcgagtgttttaggagcaagttctccaactacaacgtgcaaaaaagtcgccatcacaaaagcaatcactaagatcaatacatgtgagactgtttcacttacatgaaaatgagcaaataaggggtgcaaaatcacttcaaaagtcgattctccaacccagccaattcccaacgctgtaaccgtgatccctaattgacaagctgacaaatattcgtccaaatgagtaatgacctttttggctgatacggcacctttttttccctctaatatgagttggtcaatttttgatgacctgatctttactatcgcaaattcagtcgcaacaaaaaatgctgttaagacaattaaaatagtaaagattataaggttaatggttgtcaatgatttgccttacctagtaaggcgtacacctccgatataaatatttatttttataacccgttttttctgaataaacaaaaaacagtatatataacattataagttcaaaagaacctaaaatcaactctgaatgatgtaaataatcatctttttccgtatggagagtggttcccgtagtattcaactagcgattggtgacgttttaaggcttaaaatagaaagcaaaataaaaacacacctgaattttctggtgtgttttaataatatccaaccgtcttgatttatttaatgtctttattaaggttttcttttaaaatttgaatcaattccgcctgttgctttatatttttgcggccatttctattaattgcagcaagttcacagacaattccagctgaaatgaaaaacaataaaccttcaaacattttaaatcccccaccatctaagtgatagtcaaatttgttttttctttttgtaatacctgcttataatcttccttacgctgatatatgttatttaaaatgagtccaataatgacaaacagtgttcctactatatcaaatgcagttatgttatatcctttgatcaccatgattaacaatgtagtaatggggacaaagttaataaataaaatcccattaatggatgataggattttaatgccatagttccaactaaggagggctatgatacctggtaaagtaatcataaataaaaaatcatacttaattgctgcaatcactttaatactcggtaccgacacgtaaccttgcgcggtaagtatagctgtcatgattcctgttatagctgtgccgaataaacatgtcaatgttgaataacgaagtgtggaccactctcggaatatctgtccccccattgtgtagacaacccaccctaaaacaccaatgaatataaagagtagcgagaatagatgatcccccaataaaaaaaagaaacttatattacctttggttatgaccatcgaagcccccaaaaaggcaatcaatatactgatcattgtgtattttttaggtttcacatgtttatatccccatagaataacaattgaaagcattggcatgagtgcctcggcaatggatgctgtcataattccagacttccccatcaacctttgacctaaaaaaataagaacattgtatacagtaaacgccataaccccaaataaaatgatccattttgctttaccctctaaatgaaatgatttttttccttctcttaccaataataaaatcactaacataatcgttaccacaccgtagcgaataaatgaaaaataaaacggatcaataacttctaatgcatgatctgcaactggaaacatcgcgccccaagacatacttgctactaaacatgtaagggcaccaatgaataattgactttttttcattgaattcccctccttttctttaaaattacaatgagaattataaaaagaagtaagcatcaagtaaaatgaacaaaagtgatgaaaaacatcattgataatgatactttaatgaagggggatcttcatggaactgcgagacttacaaattttcaaatgcgtagcccatcacaagagtattaccggtgctgcaaaagagttaaattatgtacaatctaatgtaactgcgcggattaagcaattagagaatgaactcaaaacacctcttttcaatcgtcataaaaaaggggtttcactaagcccagagggccgaaaaatgattgaatacgttaacaaaattttgaaagatgttgaagaactggagcaagtctttctagatactgatataccttctggaatattaaaaatcggtacagtggaaacagtgaggatactgccgaccattatagcttcctattataaaaagtatcctaatgtggatttatcattgcaggctggtctaacagaggaacttattaaaaaggtcatgaatcacgaattagacggagcttttatttcaggccctttgaaacattctatcctggaacagtatgatgtttatactgaaaaacttactcttgtaaccagtaacaaaacgtttaatatagaggatttttcaacgactccgattcttgtttttaatcaggggtgcgggtatcggtctaggcttgaacagtggctcaaagatgaaggtgtgctcccaaacagaatgatggaatttaacatcctggagacaatcttaaatagtgttgcacttggactcggtataacagtggtaccggaatctgctattatgcatcttgctgcacaaggtaaggtttattgtcacccattacctgagaaagacagctgtatctcaacaatctttatacgccataaagatgcgtacctgacaaattcaatgcgcagcctccttaagaccattgttgaacataaaaatatgagtatgtcttaaagtgctttttctctttctatgttaacttcttaaataaaagagaaagcgcatctccacttcgctacccttattcacgcaaaaaatagagcagtaaacatgtgagttactgctctgcttcgtttatccaccgttcatttgttttacaatgtattcagcatcatttcctacaccttgaagcaacgctgaacctcgcttatgctgccaaggcaaccctataaagtacaatccttctacaggtgaaacacctctatgatgtatgattcgaccttctttatccaaaacaccttttatatttatccaacataagggattcctgaaaccagtagcccaaataatattgtttacttctaatgtagatgaatctttaaaaatgatttcattttgctttgcggcaatgactcttttttttaagatgatctccttctgttttattgcatgttttaattcatgcccaaatactggatcacctttcttttgaatgaatttgcctactattgatgtatgacttgcatgtaaaactcctagtttatcaaaccaccaaaagatgcttctttttcctatcattaaagggaaataaacaagtttattactacaagctaaatatgtaactctttctttggataattcaacagctatttgagcaccactattcccaccaccaactactagtacatttccatatgccaattgttttgaattcttatattgtgatgagtgtagttgattaatattatcggataaatcctttgatattgatggaatattaggggtatgaaaaggccctgtagcaatgacaagattcttcgtttgatattcttcccgatttgtttttattaagaaataattctttatttttaggacacttattacttctgtccgtaattggattggaatttcaaattttttaacatacttctttagataagcaacaatttcattttttgaaggaaatccatgtttttctccttcaagatgcattccaggcaaagagctatacattcgagaagtaaataaaactaatgagtcataccgatctttccagctctcccccaccccatgacttttatccaaaataataaacttttgatcggactgctttagataataccctatcgagatccctgcttgaccagccccgattactatagtgtcgtacacattatcaccccgccaatttcaaattgtcagtagacagaatttgcaaaatgctagttgatctcctcactataaagttagataaaaaatttaatggtgatggtggttacgcggcttctccattttaggctgacaaaggatcgcattgtcgtgattatgcgcttcggtttccatttgaatggttacgtgcgtaatgcctttatgctcaagttcatgttcaattttgcgtaaaatattttcactttctgaaatggtcagttgatcgtccacaactgcatggcaagaaagagcattcaatccgcttgtgatagaccatatgtgtaaatcatgaatgttttgaattccctctgtcccttcaattgtacgaatgatatcagagacatcgatattttctggagttccttccattaagatgtgaatggaatctttagtcacattgtaaccgcttcttagaacaagaatagccacaatgatactagccaatggatctgcccagccccatccaaagaagatgataagtatggcagctaaaatggcacctacagagccgagcatatcgcttattacatgtaaataagctcctcttatattcagattattctttgtatctccgccactcatcataatccaagcgaccaatagattcacaactaacccgatgatactaattgtaagcatgccggttgctgctacttttggtggattagagaagcgttcgattgcttcataaatgatataaagagaaataagaattaaggcagcaccgtttatcacagctgcaagaatctcaaatcgtttatagccgaatgtcttattgtgatttgcctttttttcagctaatgtaaaagcaatcagggcaaccattaatgaaattgaatcactcagcatatggcctgcatcagataaaagcgccagactatttgttaaaaatccacctatagcttctattatcatataacctgtaatcatgataaaagagatcaataaaacctttttatttgctccttcattatgattgtgacccataaaaaactcctccttaactaaagtttttaatacatatgtatttattatttcaaatctgttatgaagcattctaacatgatgcaaataatatttatatatgagcatgtgttcatatataaatatatctgctctttactgaaatgtcaaaatattttttatagaaatcaacaatacctccttaattattctcttattaacataaaaaagcggaacaaacacatggtttgctccgctaacctagtttctctatccttttcttgtagtatgcaactacaatttacctgttaaaaattaggcctcaccaagtccaaaactccagtcagcattatcattttcaacaatagatacaattaaatcagttgatgcgataccacactcagattccagtctttcggctaacagcctgtagaatttttgtttcttctcttccggtcgggatttacttgtaacagaaagaacaacaagatttttggttcggttaaatcctaagcctgtatcctcaataatcatatgattttctggatgttcatgcacaatttgataacggtcctgttgaggcacatcaaaagcctctactacaacattgtgagcgacatctaaaagttttttcaaacttgattgatctcgcccttctattaagtcaaaacgaagtaatgacataaaatcccctctttctactgtcagatatttctaatcatctgctacataatgtgctcatttttattcttactacattagaataaaataatttcccaataaccccttcattctgttgttagtcaagcctatgttatgatgtgtatttccataggcaatatacagaatcaacttcgagtaattaaccattttttgaaatagccttatcacttactctagaaatcatttattcttctaagctttagtttacatgaagctctgctatcatatataattcaaaattaagatggaagacatctcaaaatcagatatcaattatggaggactgcatgaatattcagttgttacaggtttttctcactactgctcgtgaaggcagtatttccaaggctgctcagactttaaattatgcacaatcgaatgtaacgaataagatacaacaactagaaaacgatttacagacaaaattattctatcgccatagtcgaggaatcacacttactcccccagggcaaattcttgtttcttactcagagaaaattctacatactattgaagaagctagagcagccatgggcgaatcatccgcgccttctgggccactgcgtataggatcaatggaaacaacagctgcagtttggcttcctcaactccttgcacattataataacctctatccaaatgttgatttgaacctagtaaccggtcctacggaacaacaaatacaagcagttttacattatgagttaaacggcgcttttatttcagggcctattgaacaccctgatttagttcaagaaaaggtattggatgaagagatggttcttgttacaagtgcttcacaccctgtgatttcttccattcaggatgttcaaacacaaacaatgcttgtattccgtaaaggatgctcttacagagcaaagctcaatcatatcctccaagaagaaggtttattacctataaaattaatggaatttggcatacttgaagcgatcattggctgtgtaagcgccggcttggggatttcactgctgcctctttcaatcattgcttcgcatgaaaaagaaggccgcatccgcagccacactatctctgacaaatattctttcgtatcaactatgtttataaggcggaaagacactttaattacccctgctttatctgcttttttaacgcatatgagggatcattttcagataaagaggccagatcaatcgtaaataaatggatggaaggcatgcttcgcctcaaaatacccctgatcagttgtctgatataaaaatataggcgcatctcaatgtttgtatagagcaaaaaagcaaacttcggtatgtagtttgctttttcttcgtgattttgcactcagaatcgtgaaacctagtcgatattaggatgtagattttcctcattcaaagaattttgaacgaaggtcattgccctagacacttggttgcgtcttgaagttaaaggctgactatttcctaaagcgtcaatcgctctcacaactattaaatattcacctacagatttcgggtgacaacgggaagattgatattttcggttggacaggggcagaacatccaattgtaacagttgaagtatccactgatggaggagatcctgcagatctgagtgatattgctgttaattgatcaacttgtttttgttcggaatatactcagtatatagccgcatattcctcctgcaatagctggaatgagccaccccagccctatgttatacatagggagaatctgagagaaaatatgattcacaacttcaatttttattcccgcctccttcaaaccgtcaaataagctgatgatgaatgcgaataataaactgccttgatacacttctgtcttccctttaaatacagaatgcaaaaacgttaaaaatattaaggaaatcgcgataggatacattgtcagtaagacaggcattgacaccttaatgagctgggttaatcctatatttgcgacaagcgtactaaacactgataaaacgacagcaatttttttataagaaatgttcggaaatagttcatgaaaaaatgaagaacacgcagtgatcagtccgacacttgtcgtcagacacgccactgtaatcattaagcccaataagattgaaccataagaaccaaaataataggatgaaaccttagccaaaacctctgctccattttctaaaatccccagttcttcaacgctggaagcccccatataggaaagggctgtatacataactgctaagagtacagctgcaatcgcggctgcttttgcacaaacacccatcagctgttttttggtagaagctccttgttctttcaatgcattcacgatgataattccaaaaacaaatgctacaagggcatccagagtgaggtatccttcctgaaatcctttaaaaaacgcttgtgatgtgtacccttttgatggtgcttgaatggttccaattgggcgaataagagctaccactacaagcaatccgataaatgtcagcttaattggcgtcaaaaatttcccaactatatcaatgatttttgaaggattgagtgataacaagcatgccaatgcgaaaaataatattgtaaataagattaatgagacagggcctgcatcatttgataaaaaaggttttaccccaatttcaaacgatacgtttcctgatcttgggatagcgaaaaaaggcccgattgccaaatagagaatcgtcgtaaatacaatgccaaacaccgggtgaacacggctggctaacgactgtaagttttgtttacccgaaaaaacaaatgctgttatagccagtaacggcaatccaactccggtcactaagaaacctgcattagcgacccatacatttttcccagccatttgaccaagcataggcggaaaaatgaggtttcctgctccaaaaaacaatgcaaatagcattaatcctataatgatgatataggaagcagacactttttttgacattatatatcctccgattaaagtagacacttcttgaatagccaggaaacattacagatgctatttgcactggcgcagtgttgattccaaaataagtttgtgtcagttttatatatttttatcaagttcaacaaaagcatgatcattttgatcgtttccgatatcggttaaaaaaccaattgcaccaaaaccatataaacaacggttccccccgctatggaaagaagcatatttttcttccacaagtgaagcagtacaactgcagctgctccaaccaattcaggaatgccatgactttcagaaagcagactcacatcttttaaacaataaatgaccaaaagcccgattaccgctgatggcagcactttaccaagatattgtacatatttcggtgtcggtttgccagacgggaaaatcatgaatggaaggaaccgtgtcagcattgttccaagcacgaccattgcaatggtgatcatttgctgcgtcatagtcatcgtcatacggaaacctcagctttctccaatggttttctcagaacagtcagtacccctaaaatggcgagcatagcaggaataataaattggtttccgccaaaaaggataagacaggctactgaaagtccaagtcctgagagagcactgtaatgctttttctctttcatccattgttctatgaatatcacaataaacagagcagtcatcacaaaatcaagcccttcggtattaaacttcacgtacgacccaaaaatacctcctatcgctgcccccgcgacccaatataaatgattaagcagtgtcacaaaaaacataaaccagcccttgtcaacattcgccggaacattagcggtataattgatagaaaatgattcatcgcacattccgaaaatcagataaagctttttctttccagtccccctgtacttatccaacatggaaattccataaaacaaatgccgggcattgaccattaatgtcaaaaaaagagcattcatagggttgaacgcaccaagtaaaaaattcgctgcaacaaactccattgagcccgcaaatatcataaaactcatgatgattggatagattgcgctaaatcccaaagaatgcataaagattccataagctatccccaaaaataaaaaccccgcaaaaatcggaattgtatatgggaatgcagaacgaaatgcagcccatatttgacttctcttattcatatgagtgtttatagcaggagagcttaaatgtaacgattctttatttttattcaaatcaacaacctcctacatttcatcaattggcacacttacagttcttttttctgtactcatgactatgcttgtgtcaactccactaatagcagggttctgcattaatgaatcaatgataaaattccgataactctccatgtccttcgccacaatcttaagcatatagtcatggcttcctgtaagtgtgtagcattcttgtacctgtgggaatttgtttatatcctctaaaaatgaatgaattgtctccctatttaagggtgataagttgatgagagctagtgctgtgacttcgattccaagttttttctcatcaacaatagtcgtaaactttttaattatacctgcttctactaggttctttgttcttgcaaggcaagctgatggtgaaagcccaattttcttagataaattcagatttgatattgaagcatcttcctgcaattctcttaagatggccttatcagtttcgtcaagcataatacccatttcataacccccaatacgacttaacagaattacatttcatccgatttaaacaataacgaattttcattcgataatcaaatattttttaaatttaattccttttaaaatattattcacagaataaaattatccccatgattacctcataattaaattaacttacatcagaaagaagtcatgggagagttatgtacttgtgtgacttgataccaacatcataagaaacttatcagaagccaaaaagttattgcggtctcaccgaaaattgaatttgcggtgccctattgcctttttctgcgaacaaaaattgttaaaattcacaaaacagaaagtctactctattattattttaaattcgtcctctagttcctcttgagcctcttgtaaaacttctaatacatcatctgcgtatgaacctaaaaatgtattgctgaactcaaaatttttcaagactaaagtgagcggcaaatccacccaccctgtcaggcaatcccataaagcgtctaaatttctcccatagtagtctgggaagtctagtttatcttttaaaacatcatgtaaaacttctatattttcaaagtctcttccatctatcattatttttctcattagaaactatgccctccattattttatcttaacaaacgttttctttgtaacagctgtttgtccaaatgaggctgaaaacaaataaaaaacaccgatagggggaaactattggtgtttacaagacattttcatgcccggtaggcataaataatgctaaactttgtttttgaaaagctatcatatcaaatttttatgttacagcttttactatcgtttaatctaattgaggagtaaaacgaaatatgtttgaaaatcacatatccccaaaaaattaaaaactaagcggcagttcttcgattgctctcatcagaaaattccctttccatttcatttgttccttttcgccttttaactgtatatttggacagcggcgtaataaggtggaaatcgcaatcttggcttctaagcgggctaactgtgcaccaaggcaaaaatgattgccatggccaaaagcaatatggcggttgttctttctttcaatatcaaatatgtcggcatttggaaatatcttctcatcacggtttgctgatgctaaagaaatgatgatcacatctttccgtttaatctcctgcccatgcagtataaacggttcagccgtccagcgaattgtcgttagctcaactgggctgtgaaaccgcaatgcttcttctatggctgaattcatcaagtctggctgctggcggagcttttcaaattgatcaccgtgacacatcagagcatatgtcatattggtgattaagtttacggttgtttcatgacctgcaacgataagcagcataatcatcgagtacaattcttctgtacttaattgtgtgccttcactttccgcttgaattaatgcactgattaaatctcctgcaggttctctcctttttttgcgaactaaggattccagatattcaacaaactcccctaacaagtggtcattctcctgaagtctttcaggggcatctgaaaaatcaataattacttgcgaccacactctgaatttttgacgatcttccaagggaatgccgagcatttcacttatcacgataatcggcaatggaaacgcataatcgtctactaggttcatgaatttgttgggctgcactttatccaataaagaatctgcgatatgctggattttgtcttccaactgcaaaatcatccgatgcgtaaatgctttttgaacaagagttcgcaagcgattgtgatccgggggatctgaattaagcatatgttttgttaaagactcttcattcttcaatagagcaggacgtttttcttttgcggtaaatacattttcatagtttttctttaatttttcattctttaataaatgtattgcatcatcatatctcgatatgagccagcctttccccagagatcctaaagataatgggtagagaggctgtgattttcgcaattctttataaaattcatacgcttcatctttaaatgctctcgaagacaattgactttccgtcaagatggttacactctttttttcttttgaagacattcattcgacctccatctttatgaaaggttatgttaatctttaaatatataatcagtacgatttgtaaaatgatctattgagatcagtattcatgctaagggccaaaatgccgcccccgcattttgaaataaaaggtatgagacagtcattaatcattttgctgcccaaactctttccctgataagatggcgaaactcctaatacttctaaataccatgccggctcttttaagtatttggaatattttccaacttcattagtcacagtcactgtcaacatgttcaatactgaaaatcctcccattttgattaatgttatcccccctgctgctatataatcgatcaagttaatgtcgggtttatcacgatgttttaatagagcggcaacaaccatttcaccattactgaatgtcaacaaaaaagaaatgctttttaaaatatgctcttgtcagtactttatgcatttcaaaaataaatgaatgatctttttttcgcgttttacgagtaaatccataaaaggatattgattgaaagattcatggagtagctttgccacttagcttattcatctgccctagcttgtcgataaagaaacattgatacatctcctctgagcaagtaaagaaggaaatcgaattaaagcgcccttcctattggaaaggcgcctgccgttttactgtgccaaaatgtttttcatcagtgagtttttataaaatcatttattaattgatcagttgtcaatattgtggcaaattcatcatgcaatgtagctagagatatattatgaatagtcgccgcatcataatatgtatcattttggtctctcattccgaaggctgctgttgcatctgaaatcaggtatgtatcaaaccctaaattaccactcattcttgtggtggttgatacacagtgaggcgtggttaaaccagttatgactacagtgtttatttcatttaattttaagaattcttctaaattcgtaccaataaagctgctatttactgtcttggttataatgacttcttcatccataggcttaactatttcctttatcgcaaacccttcattctttggatggaataaagaatgaggtttatcagaagtgtgttgtatgtatatgactgtccatcctttttctctccataattttagtattttactaatattttcttccgcctttacgttattccgttccccccattttttatcatcgaaggctttttgtacatccacaatgattaaagcttttttcttttcttccacaagataccctcctacgtagaatttctatttattactacattctaaatacaaattttacttttgtacaattgtttaatgatgaatttcgaatgagcgccttctttattgaaaaatgcgttctaaactgcaactgtgcccaagccgttaaccttcaataatctaatctgagaatcactggctctacagagaatgataaaaagcactctaataacgagtgccgaaatgaaaaactattgatttagaagccatttgatacgctcagctgaaaagatgtagtggagtattattagacataaaaagacaataccaactggttttaaatgactaaaataaagcgctgcaacagccagtgcaaagatcaataattcaataactagccttgttaccccgtttacagctattacagtttgtccacttcgactaggatcattaggtactgcaaatacagaccagacaatcataactgcaataggtaaaacccaagttaaaacatatttaaaataaccattaaagcttatccaagcaaacacccctaaggagattagtgcagccatttcaagggtgaatcttaaaagtaaattagtctgattcagtttttccaactcctctataaaaaacacccccgcaggagatgctctttctctgctttatttcagcgtataaaaacttttctgttcttcctatttagattctattgtagttttcggcgagattacctctacttttgaaaagatgataccgactgctgctgttaccaatgctccgataatagaacgatgataagtataatgaaatatgacaacttttcccctcctatccagttaattatccaaataatcaggaagttgtctacaatttgcagaatttgtcgaacgaagtaaagaatataccataaaagctgaatattgacctcgcttatcgctgggaggctttactcattgtatgaattacagtaatacactaccttcccttttgagaagacgttcctctcttatatccatttgttgcaacttagctagactcttccaataggcttccttttggcgcagctgcttctagtcgaaattgagcaacacctgaatgtttcattggaatttctgaaccatagatcgttgctgaatttgttgcaaatgcatacataggagtagtcgaatggtggttgaaaaatgaaatgaattacccacctccagtgatggcagaaaaagcgggggttttgttagagaggaatctatagacatgtgtatctagaagatttgacagcattaaaatttatacttacatcgttgggaacaggccaacaataaagcggaagaacgtagtcatttgaagtggtttggaataaaaatgattcgaatatgttcttatcattgataaacgaacaaaaaaagaacatgttttgaaaaaagattgatcaaaacatcttcttatatgttgtcatagcgtaactttttataaaaaggttgattacattttcggggcttccaaaccaaattttgcccattcttcttttgctggaccataaatacctgaaacagttaaacctgcttgtctcataagaacagtcatttgtccccgatggtggttttgatgttgaattaaaaacatcaaaagtgaaccgttaggcaattgttgtccaataaagttgatacgttcttgaagtgtatggtcagtccattgggtttttaatgcctgtacaaatgcattactggcttgatgatagctgtcagctataaactgagccgaagttggaacaggataatcttcagctggggcatggaacgttaagtctgtgtttgaggtaatgatgcgaatagcagcaacagtgtgccaggcaatacggcctagagtccaattttgtgaagttatttcttgattaagtgattcatcagtcagactatttaatagtttctgtgtagcatctgcttcgaactcccaagatttcaaaaaatggtctaaggtttgaaacacaaaaatcctcctttttattcttttgttttttcaatgtgcctataggttaattataatgcctcgtttcgttaaaaagaacaaaaattttggacaagaataatcatagtaaaatgcgtagaccttcttaaacataacgatttacgcatctttttacaaacatggtgactccttggtctccattgtcagcgagaatcaaatatcatatgaaaacaatcctatattcttattactttactgagcaataaatctcttcggtatacttagtgatgccttcatcgtaatcaggatactgatatgtaagactttctgatacagcttttgaatactttctaaataatgcatagcaagtaaataaagacttccacatttcctgatacccattcacagaatatgtagacatgagttcctcccattctttatttgaaaggtaccgtttcataaatttatagttcttccccatactaaatgaataccctttctgagatgcgatatgccaggccatcattctcaataaattaggacgtacaatttcatttaaatggtcaatggcaaaaaggatttcatttcttgctagtccttttactacgtaagtcgaaaccatccagaactcattacagcaatcatcaaattcccttgcagtcggctttttcatccagtattggcgatcatttggggtcactttatagttgatgaacgaatccttatcgagcaagaccttaaccaaaccatcgttattagcaaaataatcttctgcttcacgaattggaataagggttagatctaatttgttcccatcctcaaaaagaatgatgtatgaaaaccaattacctaattcgggaggaaaaagctccatatcttctggtttttgcatcataatgcgcttcccaaagatttcgagccactgatcattttctttaaaagaatctacatcagttacaaaatacgagatgtcataatcttggaagttgtcaggagggatatttctgtttgtacgtgacccttccaaagtgaccaatcggattctctcatcgttcaaagcaaagtccaaaaaaatgtccatcatttcctgctcacttcgcattacatgttcctccgtttcagccttaatatctaactgtaaaaccgaatattgatctgtacgtcttatagatttttttactcttgaatgtgatgtattcttctaagctttattttacatgatgttctcctatatattattcaatattaagatgcaagacatctcaaaatcagatatcaactatgacggactacatgaatattcagttttttgtagagccgccatgggacgacactatctttgacacactttaatcccccctgctttatcgacatgttaactggtatgagagattgacaaaaagaaggaaaacgatatatttaagcgaatacgagtttttgagtaaattttaaaatgacacttttttcaaaaatcatgtcttaacggggggattcggtatgaatgaatttatgaagaagttttccttaacaaaaccgattattcaagctccaatggctggcggtattacaaagccccgacttgcatctgcagtttcgaatcaaggtgctcttggcagcttagcatcggggtatcttacgccagacctgctagaacaacagataaaagaaatgtttgagctgacagacgctccttttcaaattaatgtgtttgttccgcttggtctagaaatgccaccaaaagatcagattaaaaagtggaaagaaaacataccgttagctaatcaagtaaatcaattcacatctgtacaagaagagtgggatgacttctatcaaaaaattgatctaattttaaaatacaaggttaaggcttgctcattcacttttgatctgccgcctgaagacgcagtaaaggagctaaaaaccgctggatgctgtttaataggaaccgcttcaacagtagaagaagcattgttaatggaagaacggggaatggatatagtagtccttcaaggaagtgaagccggtggacatcgcggagcatttttaccttccaaaggtgaatctgccgtaggtttaatggctctgattccacaagcagcagatgcactgagcgtacctgtcatagctgctgggggaataatagaccacagaggagtaaaagcagctttaaccctcggagcccaaggcgttcaaatcggttctgcctttttaatttgtcacgagagtaacgcacatccagtgcataaacagaaaatactagaagcaaacgaagcagatacaaagcttacgacattattttcaggtaaagaggccagaggaatcgtaaataaatggatggaagaaaaagaacagtttgagacacaaacccttccgtacccttatcaaaatacactaacgaaggcaatgagacagaaggcttcacttcaaaataaccatgatcagatgtctttatgggcaggtcaagggatacggtcattgactgaggaaatttcggttaagcagcttttaaatcagctttgccaagaggatataaaaatataggcgcacctcattgatagagcaaaaagcaaacttcgacaggcagtttgcttttttttcgtaatttcatcccctgactttggaaatttaaatactcctacattttcaaagctaattgaatcgggttatcaatcatcccactgatacggtgcgatcttgatgatttcaccacaatacatcaccaacatttcgatcttatctccccttctccagttttgctccctattcgaaaaatcgatagctcccatattaaattcgaatagtaaaatggttctttttcgtttgattcagatgatataaagtcatatgataaaaaaagaatgagacagaaagcgtgagaagtgatgaaaataggattttttgattcaggaattggtggcatgactgtattgtatgaggccataaaagttcttccttatgaagattacattttttatgcagatacgttaaacgttccatacggtgaaaaatcaaagattaaagttaaagaatatattttcaatgcagctgaatttctggccagtcaaaatatcaaagctctggttattgcgtgtaatacagctactagcattgcgatagaggatcttcggagaaacttcgactttccgataatcggaatcgaacccgctgtaaagcctgctataaataaatgtacagaggaaagaaaaagagttctggtagttgctactaatttgacgcttaaagaagagaaatttcataatctagttaaagaaattgatcaccatgaccttgttgattgcttagctcttccaggactagttgaatttgctgagaactttgattttagtgaagacaaaatcattaaatatctaaagaacgaactatcttcttttgatctgaaacaatatggaacgattgtgttaggatgcactcattttccgtttttcaaaaacagttttgaaaaactgtttgggataaaagttgatatgatttcaggcagtgtcggtactgcaaaacagttgaaaaaagttcttgcagatcgtaatcagcttggtaaaggctcgggctcaatcacctttttcaattctggccataaaattgtagaccaagaagtcatatcaaagtacaaaagattgtttgaaatattagatgaaaatcaaaggagtcatgttggacattgaatgtaaggggctctggttataaacaatttttcagtaaattcacaaaagagagaagtatgaattcgggtttgttatccaatgtaaatgaaaaagacagtctcatgaagaaaaacatgaactaagaagcgggcttaaaaagcccactttttttctaacaaacaattgagttatgcacaaatatctgattacagtgttttcgctctttcccctcttatttctaccccatctctatagcttttctatttcaataaaacacaagtctcgattgaaaagttatcgtaacatttacacttcacaggacatttttcgagattagaaatcgaccgtttgccagatacacaaagtcataatgtgtaaattctgtgtctatttgcatgtttattatggaattattttcataatgttttataatacaagatgatagcgttttctaattataatgatagggggaaataatgatgatgaaaaaaggactgctcgcgggtgcgcttacggcaactgtgctttttggcacatgtgcagtagatgtgccgggtattattagtccaaaaaccgcagaagctgcatcacagctaactgatggaatcggcggaagggcttacttgaacagcactggtgccatttttgttacgaaaatccagcttcctagctccattcaggtttcaaatgggacagcctacatctactctggctttagcgggggcacagaatccgatatcgggcttcagtacagtgataaatataatgtatggaaaccatatatgaaagtcggttcaaaaggacaggatcaggttcagtacctcgaaggaggaagccaattcacgaatacgaaaggcttccgtcccggcagcaccgtacaacttaccatctacaaaaaccttaacggcaatacacgcgctacatactggggcacaaacaatgcgggatacaacggccgtctcatttcagagatcagcaaaacaaatgtcggctccatctccaaatggaaagcgctcgctacagttgcaacaacaggttcacgccaatctatcaaatcaaacttttcaacatcttttacaaacatcaccatcgacaacaaagcaataacacctgtaattgatacacaagacttcgctaaagtaacagtctcaggcaacagtgtcagtttatccgttgtgaaaaattaaaacatgttaaacatacaatgcgttaggctattgagaagctctcgatagtcttaaagggggcttaacatgccccttttttcatttcaatttaactttcagttagcttcggtgcatgccgtctatccccgtcttttatctgggtgaagtaaggagcagctcgccccttctgagcctgttccatttgctcaacgcaaaaggtgtgcattactgtcttaaaaatgttaaaacaaatggcagatggtgcactttatttttagatgaggcatgcttacgctcgatatgcaagtcaaatgattaagggtctgcaagagagagaagttttgggtgtactttcataaaagagggatgtcttcatatagctcgattgcaccaggaacattaaccagcgattggccgagaacaacacatcactttgaaacggattcattccaaaataataagtatgatcaataactaataaagatcagttagcagtccagccttaaaaatatttttacatcaagtaaactagcatcactatcgaataagctcgatctgcatatcatgtactatcctcttttaaggaaggtgatgttatgaggtcatttccattaattgtagttctattcatcctattaatcatcgttgggacatctttctttggtggctattaagaacacaccttacctcatatccatcagacgccataagaaatctttatggtgtctgttttttattagatttaaacaaaaccattaaagtggggccatgcaaacacacctatggagattactgccacgacttctttgtgagggaaatattcttccctttatggactattgtcgatcaaaagagaaagttgaaatacctttttatggtgagatgaatcgaggcttagacatataaaaaaccgcaaagctttcttgaagaagctttgcggtctttgggtctcttctttgcttcatataagccaatagatttcaagcgtaatccactgccatacatccaatgattttttattttgaaataggtttcttctactcttcctgtgagatgactcaaggtatgccacgtcacaataatgtggcggatcctgagtggtctcaatcagttttttccccattctatcaattctccacagaaaaaatggctatggcagaacaactttcatagagtaatcatcatttaatgagccatcatctcatgggcaatatcgtgtccatccatttttgacgggtagtaggtaggccaatttttgacttcatcaagtaaagcttcacggtcgtccccccaatagagatgataatgactagctttagtcgggtaaatactatgatcactaaactgaatatactgaggcagctcttctgcttttttagctagtttgaatatgtatcttacccctctattgcccgcatcataggtgagaatttcgtacccgtcatacgtatacttaccagaatattcttttccatttttgaagaacgttacagtatctttctggattacaatacggtcaacatctgtttgatagccttttttataatactctttatattcttcagctgtcttgccgccttcgtgttctgatttatatgaaaacacttcgtcaagagtaccatcttgcaggtatggatatacagattgccaatctccttcccaatcagaaagtaagcgatcctttacttggctgtttttaaaatagccttcatatattttttctgtttcttcatcatgcgcatgactatgatcgtgagaatgttcttgtgtatgactgtcagatgtttgctcttgcgttttggaagagtcttcttcaactgctgaggatgatgttgtttgattagactcacctgcagaagaaccggaagtctgacatcctgccaatacgagtaatgaaccaatcgttaatatgcctagccgctttgaaaataaaatgttcattccaacactcctttttattaaatcgaaaacattacgatttatattatacatacatctcttgcaaacatcaaagggaaaatgctcttcatgcggatggactattttaaaggaataactgactttgttcatcagttattcctttaaaatacgaaagtctacgatatttccatatcgatccgcttcaatattacagcacccctcaagcagctgttttaattttccccgtccgcgttgtacccttgattttgctcctgagtaagaaatgccgagcttttcactcaactctttctgtgataacccctgaaattcagttaactcgagcgcctctcgatacttttcaggcaaccgtttgatggtcgatcgaatacacacagttgcttccttggtgaaattttcttcctctgcacggttattaaaatgtagatcatcaggcaatatttcgcttgttttttttgtacggtaaaaatcaataatcgtatttctagtgatccgataaatccagctgtcgatcttttgttcatcgatcagatttgggagatgcacttgtattttcataaatacgatttgcaagaggtcatcaacgatagattgatcgttaaccctttgtgaaatatatgtttttaacggctgatgaaattgatcccatagatcctctatattcatttgaaaaaacctcctataattttgcgtctgctttacatttgcttcgtctttttaatcgtaacaaagagcgaaacaattgttgaatcaattgtattgcagctgttgcaaaaaataatgataaaggagaggtttgttgtggagtatacctatttagggagaacaggattgcgggtgagccgtttatgtttaggcacgatgaattttggagttgatacagacgaaaagactgcgttccgtatcatggatgaagcgcttgataacggcatccaattttttgatactgccaatatttacggctggggcaaaaacgcaggattgacagagagcatcattggaaaatggtttgcacaaggaggacagcgccgcgagaaagttgttctggcgacaaaagtatatgaaccgatttctgatccgaatgacgggccaaatgatatgaggggcttgtctctatacaaaatcagacgtcacctggaaggatcactgaagcggcttcagacagatcatatcgaattgtaccaaatgcatcatatcgataggcggacaccgtgggatgagatatgggaagcttttgagactcaggttcgctccggcaaagtagactatattggatccagtaattttgcaggctggcatttagttaaagcgcaagctgaagctgaaaaacggcgattcatgggactcgtcactgaacagcataagtatagtttattagaacgaacagctgagatggaagtgctgccggctgcacgggatcttggtttaggagtagtggcgtggagtccccttgcaggagggcttcttggcgggaaggcattgaaaagcaatgccggaactcgtacagcaaaaagagcagatttaattgaaaaacatcgtttgcaactcgagaaattttcagatttatgcaaagaactaggagaaaaagaagcaaatgtggctttggcatgggtgctggcaaatccagttttaactgcgccgatcatcggaccccgaacggttgagcagctgcgtgatacgataaaagccgttgaaatcagtctggataaggagattctccgcatgttaaatgatatctttcccggacctggaggagagacacctgaggcatacgcctggtgatacattcattactcaatactgacatttttcttaaatatttatactgaactatcatattaggaaagacaagagcttgtttgtctcttgtcttttccacatcatgttgaaaatgctggctaaacatcgacaaaaatgctgccgcttctaaaaaagaaccctaaacaatagagtaactggaaagacaactggcttgatcagcttgggacccctttcagctgtatttaaatcaatcaaactaatgattcattggcagtctaaatattattattgtttgtttacaaaatagtaatagcccctgtaatgattgctaacaacgtaataactaatgatgtaattacagcccacttaacggcaaacctttgaaatgaccccaagtccattttaagcatacttactaacagtagtgttgacgcaactaatggactcatcagatgaaccggctgccccattatagaagccctcgcaatttctactggttctataccatatgctgaggcagcttctgcaaagataggtaccataccaaagtaatatgcatcatttgataaaacaaaagtaaacggaatactagtgagtgctacaataacggggaaaaaccctcccattgatgagggaataacggatattaatgatcctgctatggcatccaccatctttgtcccggataatataccagcaaatactcctgctgaaaataccaataatactacagttatggcattaccagaatgctcggcgattcgctccttctgcatttttacattcggataatttatagtaagggcaagaacaaaaccaattaaaaataaaactgacggatgcttagttccaagcacaataaacaccatgatacttataacgaggaataaattaagatatattaagcgtggccttttcaattgctcgctctccaaactagcagccatataagattgagagctgtcctttgttatatgtctaggctctaattgaacgatgcctattcgattcctctctttccttcccattagaaaagccagaaatatcacacaagcaatacctccaagcatggtcggaagtaatggcacaaaaaaatctgaaggatccaaacccagcactgaaatcgctcttgtagctggtccgccccatggagtcattccgctaacgatactcaacgacagcattgctaatgtcgccataaccatgggattcataccaattcttttatacaaaggtaacattgctgagactgttatcatataggttgttgtaccgtccccatctaaagcgataagcattgccaagacggcagaccctatcgctattttcacagggtctccctttactatagataaaattttttctattagcggatcaaataaacctgcatcaattaaaattccgaaaaaaagaatagcaaacaatagcaatgccgctgaacttgcaactgtttgaattccttctaaaatcatgtcgccaatacccttaccaaaacctccaataagagcaaaaacaatgggagtgatggtcaaggcaacaataggcgagactttctttgtcattattaatattgtaaaaacagttaccatcgaaaaacctaaaatagtaagcatattacacctccaagaatgcgctttcaaatgacttttgattaacatatcttatacggtgtaataagttaaataaatatttttttactgtgtttcaaaaaaaattctatcataactttaaatggttaccatttgttcaccctttaaaaaatcaatgaatgctttaacgagtttgattcctaatgatttttgatcgtacattagccaagtatctctcattagaggcttacccttagcattatacagttccattgtgtacaaatgatcagattcctgcaggcaaatttctggtgctatggagtaaccaagaccatgctttaccatctctttgcaagtctcttgtcgatccacttccattgcaataatgggggcttgttttagattcgtatgcatccaatcttctataatcgtttttaaagaagcatccgttttatatttgataaaaggtaaaaaaggaagctgctctatcgttattggtttttttgagatgatatgtaatttttcccgtgtcagccgttcctccacccctttccagcgatggcttcctctcagtataccgacttgtacaataccagcatctaataatttcatgacatctgtgctccagcctgtttgtacactatattggacattaggatacatagtggaaaattcccttaataacttagggagcttatattgagcgaaattgcttgatacccccagccttagatgtccttgcacctctttgcttagattagagatatgatctttggtatcttgaagttcctgtagcattcttcttgcataagcaaccaagtgttctccttccgcagtaaaggtaattcctttatgccttttggtgaataattcaattccgaaaatctcctcaatcttattcaaccgataagtgatggaaggctgtgatgtaaataatcgttctgctgtttttgttacactttgttcttcgtgaagaattttcaataaaatccaatctttctcatccattttcatcttcctttctagtccttctttcacaattataaaagtttttttatcgaatattaagaaaacttatattttatttttatttttttaccttctacactaaaaaacataaaaaatactacctttaagatgaggatgatgacgatggtcaagacgaatgtaacaatcatgagaggcggaacaagcaaaggcgtttttttccacgaatcagccatgcctaacaataaaaacgaatgggagccctttttgcttgatgtcatgggaagtcctgataaaagacaaatagatggtttgggtggcggtaattcccttactagtaaagtggcaataataaagaaagcatatacttcggatattgatgttcactatactttcggtcaagtcagcatttcggaagaaaaggtggactttaaggggaactgcggaaatatctccgctgctgttggtccatttgctatcgaagaaggacttgtaaaagcgacagaaccaatgactgcggtaaggatcctgaataccaatacgaataaaatgatcattgcggaagtggaagtggaagacggtcaggtcaaatatgacggagatgttacgatatctggagtgcctggatctggatctccaatctatttaaactttcatgatgccgctggttcagttaccggtcatttattgcctactggaaatagttcggagtttttagatacaagtcaaggccaaatagaggtgtctattatcgactatgcaaatccattagtttttgtggaagccagcagtatcggcctggagggaacggaacttgcagaagaatttactgatttacagttggctcaatttgaagaattaagatccattgcggcagagaaatgcggctttgccagtcgattttcagctacaaagttatcgccggctgtccccaaactggctatagtagcaaaaccagagaaatataaagatagtacaggtgcttggcattcaagcgttgagatggacttacacatcaggatgatgtccatgcaaaagccacatcaagcactggctgtcactggagcgatatgtacaacaagagccctttcagtggaaggtgcaatccctgcaagaatagcaaaaaaccactctacaaaggttcggctagctcattcttctggtattattgaaacaatggtggagcccactggtataaagatcgtccgtaccgcacgacgtattatggacggaacagtttatacgcatggagactatcaaatgatgtagatggactgtgcaaaaagcctccccctttccatcgttaatagatggattgaatgcgccttcttgcacagatccattgtaatcttgcatggctttaaaaaagcctctatattgtattttatgaaatcgccaaggtcctttcatgtatctgcctcaagcatgacataatcattatagagaaaattgaatactttttactgcaaataaaaagataccaacatcattggtatcttttagattgagttcatctgcagcggtttcttttcctcactgcttatttgattacaaaattaccgtactcgtttgaacgaacatgaatcggtccgtttagattatagttgttctccttggcgatagagcgaagcacgtccacacgggcaactgattctctccattcgtcacgggtgtcatgattggccggattcatcagatcgtcatagcgtacgtccaagaatttattcaaccacttcttctcgtctattccgtctttaggtgatccgcccgcttttttgttcgtacgtttaatcaaggcataaaaagagtcagggtcatcaccatcgccatgctgaataaccgtatcgtacatcacagctctagccaatgctgtttttagtccggcattatccgatcgtttcatggcaggctgataatacaaatggtcatttactttgtcttgagcggcgcgaaattccttatcatttgcaagcgacttccaggcagaagcgaatcccttgagattgcttgtatcatcgctttcttccttggccagacggcgcaattcagtcagatactttttcagtttgttattcggaactgcctttgtgtatacttctactacttccaatgcatccccggtagccgttgtaaagcccgcccgtccgcatgtatagcctcgcccgtcatccaatcgctctacatatccatattggatctccgttgtgccgttttcaaagatacttgtcagctgttccgcccggcgcttttgatctttattcagtcccgccgcaaaaaccgtttcgctcatcatcagggtaaaaaacatggtgaaaacaagtaatgagatcgctgcttttttccaaaaatctgctttttgcatactgattttcattttacttcccctttctaaatattgtaaatacagactcagtatacatgatgaaactgccctattgttgaaaatacatcaatttgtaaatattttgaatctaaagtaatatagcttgaatcttactcttttcattgccaatcagccttagcccctctcactgggaaggtccctttcatactgcttcaactttcattaacaagatgccataggctttactctattttataatggaagtgatcatcgaaaatcgttagggaggtgatgtaaatggcaagcaagatgagaatgccagattccgcaacgtcccatgcaaagcctactattgggaaggcgatactttgcatggggtagactttctaaaagatcgcccaagtaagcttttctgatatagtggctttgcaccttatttgacataaaaaaataaggagctggcagaaatggcatatgtaaaagcaaccgctattttacctgaaaagctgatatcggaaattcaaaagtatgttcaaggaaaaacaatatatatccctaaacctgaatcctctcatcaaaaatggggtgcgtgttcaggaacaagaaagctgatcgatgacagaaacgcttctattaaaaaagcatttaaaaacggcaaaaccattcatcaattatctgatgaatatcacctctctattgaaacaataaaaaaaattgtctactctaaataaacaaaacggaagcactgataaaaaataatcagtgctttttatatggcgagtttgtttcttagttatttcctgcatatgataccattggccaattgtgtaaagttaagggagatgagaagaaaggaaggtcctacaaatgacgataaacaatggaacgttgcaagtacccggcgcgaacatccactatcaggtgcgtggctcaggtccaatcattcttttggtccacggcggaggcggtgatgccgacaagttccatcatgttgccaatcatctggctaactggtactcggttgttacttacgatcgccgcggccattcccgcagcaatctcgccaatcagattgaggattaccgtgtggaaacacacagtgacgatgctcaccgtcttctagccaaaatcaccaataagccggcctatgtatttggaagcagctccggggctgttatcgggcttgatctgtgcatacgccatcccgaacaagtacatgtcatgatcccacacgaaccaatcttattgcagcttctgcatggaaatgagctgaaacaagccgagcaattcatggaagaccttaagaaaaatcatcaaagtgaagtcattaagttcatgtcaagattagagacagacgaacaatcaaaggctgtgctgacaaagcggcttctcggcaattcaacgtatttcactgagtatgaaattcaaggaattctcagctatacattagatttcgaagcattaaaaactgtgtttacatcttcaccgatgaagatactcccagctggcggaagtgcttctcgggagctttttccttatcgttgcgcgaacgccctagcggaacaattggaaacagaatttgttgaattccccggaaatcatacggggtacacaatgtaccataaagaattttctgagaggttacacgacatgttagaaaaagaaaataaacatacgtgttcaaaataggacaggtaaaactaactatggaattggagaagatttcacgaagcgtaaaaagaacttttcactaacgagaacgcaatgtgagatgtttaaccaaagtgatattagggatttcatcgaaaaataggtttgtacattacgttctcctattgattatttcctatcttaattccgtattttataccattagatacaactctaaagcggctcgttattttgtcctcaacaacaaccagtgtctaacatcatgaatctcttttgaaaatcaccacaaatgcaggtatggaagacttcatcgcagcaaaaaccataccaactattgttgttggtatggttcgtcctagataggcccttaagaagagattctattgtacggagtatttagctaattgcatttgtaaccgacagggccgtctgaacctgtgtacacatatgtgtcagacacatatccaatattcacgacaccccgggaatctttccactggatttggtcccagatattactcgttccatacttccctgtaacagtcgttccataagcgtaacaataataaggaacacgggagccactcggaatggaaagcataataggataatttgtaccaggaccgctgcgcatattgacaggcgcaccgctgcttgttgagacagtaaagtactgcacggcaagtgcctgactggaaaaaatgaataaagatgcaatcatcacggttaacatactcagcattttcagtttagtcaatgtcatccctctttcttcaattccttcattttaagaaacgatagaacaatgctaccagctgcatttaggaacaaccggaccgtctgagcctgtatacatatatgtatcagagacaaatccaggaacgatctccccgctggcaagcgtccgctctgtgtaattccaaatgttactcgttccatactttccagttacagttgtaccggttttgtagcaatagatcgggatgcgggttccgctcggaatagtcgttacaattccccaacttgtacctgggccgctgcgcatattgacaggagcaccgctgcttgttgaaaccgtataatactgagctgcaagtgcatggctagaaaaaatgaacacagatgcaatcatcaccgttagcatacttagcctctttagcttattcaccttataccctccccttataaatgccgtacgtttgactttcttacatccagttaaggatttactttcagataccatgccccctcccctctcatatatttatcaatgtaccataaactagatctttcaaaagtggaattattcctatgttttcgacaattaaggatacaaaataaatggtagtcaggcttgatattgatggtgtgttacatttggcatttgtccagtcggtaatcacgattgacaatcaggaaaaaggacatggatcaagcggtttcgtgtccaccaattaactcaatcagtgtacttctgccttgtatccacgcttcttctcgattcatagatactccacctttttcaccaatcaaaaacggacaccaaacaaatcagcgtaaatgctgcaagttcagtgtccgcaacctattatgactttgctttcttttaccagggcgtataaaaatgattaggtacgttatcaaacgttatattctatgattttgcgagtcgaaaaatcataacattttatatatttcaatcagattatgatctggatctctgaagtgagcaactcgggcactccattccttgcgatcatgcggtttatttacacatttaactcctttttcgtgtaaatcgtcatatgttttatcaacatcttctaccttaaactgaagcaaaaattttgattgagcttctccttccaacgattttttttcctctccaacgatttcagccatcgtttcacgagataaaagctctattttcgtttccccattatcaaagagtgcatattccatttcattctctaaccaacttattggaagtcctaatgaatctttgtaaaactccacgcttttcttaaaatcattcaccaacagtctaatttgtaacagcttcatatcgagtgcctcctataaaaccatactttttactggtcatccaatttaatgatacaaaaggaaacctgacagcactatgtcaagtttccataaataaatttcctacttcacctttatttcagatttaagtgcagtttattccatgtcataagaaatgtacgctaacgagcaaaaacagcgattcttaaaacaaaaaatgataccgagtgtattttctgtatgcttcaacttcatttcgggaaatgtaacgttgataaaggaggttacatcaatatggatcatcaaacattggcagctcacgaggctgttgacttacatgaaatcgtgaactttaaaacactttgtatagcgaaatcaaagttaatgcaaggacttgtgtttgaccaagaactgaaggacttgatgcaaaaagatgtacagcaatccattcaagaccttactgaattacaagcggtttatgagcgtgcctcatttcaggcccctgtccctcaaagccgcccaacgccaatcatcaattgaaaggaaggtaagcctctttgaataatgatcatttagaccccattaattcgctgaatgtgcctgaactagcagacactacattcgcgatggattttcttatacgagctaaggaaggcgtaaggaatactgctgtagctttgacagaaaccgcttcaccagatgtaagagccttgctgcggaaacagctgatgcaaggaattgcaatgcaccaagagattacggaactgatgatcagcaaaaaatggttccatccatatgagctgagcgaacagtataagctggatcagctctctgcaaaaaacacgatcatggtcggcaatatgaacctcttccctgatgaaacaaatcgtaaagggatgtttgaccggacacctgatgaacactaacactggaggttttacagcatgaaggcagtaacgtatcaaggcattaaaaatgttgttgtcaaagatgtccccgatccaaagattgaaaaatccgatgacatgattatcaaagtcaccagtacagccatttgcggatcagatttacatttaatccatggattcattccgaatatgcaagaagactatgtcatcggccatgaaccgatgggaatcgtcgaagaagttggttctggggtgactaaactaaaaaagggagatcgggtaattattccctttaatatagcatgcggggaatgctttttttgtaaaaaccagctggaaagccaatgtgatcagtctaatgacaatggggaaatgggtgcttatttcggctattcagggcaaactggcggttatccaggcgggcaagctgaatatttaagagtgccgtttgcgaattttacccattttaaaatccctgaatcttgtgaggaacccgatgagaaattaagcgtgattgccgatgccatgaccaccggcttttggagtgtggacaatgccggcgtaaaaaaaggcgatacagttatcgttctcggctgcggaccagtcggcctgtttgctcaaaagttttgttggctaaaaggcgcaaaacgcgtcatagcagtagactatgtaaactatcgcttacagcatgcgaaacgtacaaacaaagtagaaatcgttaattttgaagaccatgagaatacagggaattatttaaaggaaatcacgaaaggcggagcggatgtagtcattgacgctgttgggatggatggtaaaatgagcgatctcgagttccttgccagcggcttaaagcttcatggcggaacgatgagtgcattggtcattgcttcccaagctgttcgcaaaggaggaaccatacaaattacaggtgtgtatggaggcagatataacggttttccgttaggagatattatgcagcgaaacgtcaatatacgctctggacaggctcctgtgatccactatatgccgtacatgtttgaactagtatcgacaggcaaaattgatccgggagatgttgtcagccatgtcctgccgcttagtgaagccaagcatggctatgacatttttgattcaaaaatggatgattgtatcaaagttgtgttaaagccttaaaaaacggaggttacagaaatggaatacgccttacacgaagtgcttgaggttcaggaaatgactgcatttaagacactttgtttgacgaaatctaaaacaatgaaagcactggtatctgatccgaagctgaaagaaatcatgcagcaagatgttgatatcaccacacgccagctgcaggaatttgcctctattttatctaatgcaaagcacgaatgaggagatgaataaatcatgaatcctatcatagaatatctgactggcatgaatgttctaacagaccaaatcattgctatggacttattaatttcagcaaagaacggagtcagaaattatgcgatggcagccactgaagccggaacgcctgaagtaaaagaggtccttatccgccatttggaagaagcactcgatatgcacgaacaactctcaagctatatgatggaaaaaggctggtaccatccttggaaccctgacgaacaagtcaagctgaatttaaaaaatattgatacagccattcaattgccaaccctttaacatacaatgactgatttgctgaggaacagtattgattggccacaactgttcctcagcttcaaaatgagcactgtttgttcgggtcctatgaccgtaaatagattaaccgcttttctccatctgatctccgataatgtttgcaaattctccaatccaaataaggaatcgtaaccacctctttttatgcgatctcttgatggagaaaacaggccagaaacaaaatccttcgtttttgacctgccctcttcacacgcaaagaatgctaccttctttgctccactgatccgtgaagactttccgttttaggcctgcttttgagctttgcctcattttcacgcaatttcccatcataatctttaatttttgtgtctaatctcttaattgtttcatcaatttctttccgcttctctatcagccgctgtcgttcgtcagccaggatattttttcgagcttctaccgtacagtcaccttcggtaaataatgttgtatattcaattagcgcttctatcgatagtcccgcatttcgcatgcatttaatgaattcaatccatttgatatcttcttcatcatagtcgcgaatgccgctgtcttttcgttttacaggcgggattaatcctacacgttcgtaatatctgagtgttgcggctgtcaggccaaactgctttgccacctgagcaatattcatgatcttcacctctctatcctgcatgttgtgaaggtaacacttaaagttaactttaagtcaagctcaagacaagtggttagctgctgaatctgggtttatatattcgggacttgccttaaagcacactttaagctctatacttctccatgcaataaaaacagtgtagatggagggattgctgaatggcaaataaacaaactgccggaagagaacaaaccaaagtttgcttaacttcatgatgatgttctattcggtgacatttgggaaagagaggaagaacttccccccgagatcgcagcataattacagtttctacgttaattgctgactgtatctcaacttataaatcaggttcattttaaatgttattttaaaaaaacccttgccttaaagcagactttaaggtttatcgttatgttgaagacaccataaaacataaataagtgcatgtttttttacaacacttatgatgaagaaagggaaggttcatatgtgtaatcaacatcaaacccgtgtattaagcgtgtcacatgcaaaagccaaatttgaacaaacgacgattgagcgaagaggattacggccgcacgatgtcttaatcgatattaaattcagcggtatttgccattcagacattcatagtgcttttgatgaatggggcggtggcatcttcccaatggtgcctggacatgaaatagccggtgtcgtaacagccgttggagcagaagtcaccaagtttgctgtcggagaccgcgttggtgtcggctgttttgttgactcttgcggagaatgcgaatactgtctcaacggagaggaacaattctgcacgaagggtgttgttcaaacgtataactcagtagactacgacggaaaccccacttatggcgggtacagccaaaaaatcgttgtcactgacagatttgttgttcgcataccagatcgtttggaaatggatgttgccagtccgctgttgtgtgcaggtatcaccacgtattccccgctgaaacactggaatgttggccctggtaaaaaagttgcgattgtaggcgtgggtggccttggacatttggcgattcaatttgcacatgcgatgggtgcagaagtaaccgttctgagccgttccatgaataagaaagaggaagctctggaactcggtgcaaatcattactttgcaacaagtgacccagctacattcactgcattggccgggcgttttgacgtgatcttaaatacggtatcggcaaatctcgatgtagatgcctatttatcaatgcttcgtatagacgggacacttgtaaacgttggagctcctgccaagccggacacatacagtgtgttttccctaatcatggggcgccgcagcattgcaggttctctagtcggcggaattcaagaaactcaagagatgctggatttcgcagctgagcatggcatcgaacctaaaatcgaagtcatcggagctgaccaagtggacgaagcatacgaacgtatcctccgaagcgatgtccgttatcgatttgtgattgatatttccacattgtaataggttattccttatatggggctgacccgcttttattgaaactcacgaaaaacgatctcgttaagcaaatattttgaaggccggtcaatcttcctgttattctatgaatagagagttattaggagggttttttatgagcaaaaaaatcgcagttcttgttacagaccaattcgaagacatcgaatatacaagtccagtaaaagcatacgaagaagctggctacagtgttgtggctatcgatttggaagccggcaaagaagttaccggtaagcatggcgagaaagtaaagattgacaaagccatctctgatgtggatgcaagtgactttgatgcacttttaattcctggaggattctctccggatttgcttcgtgcagatgaccgtccgggtgaattcgcaaaagcatttatcgaaaacaaaaaacctgttttcgcaatttgccacggcccgcaagtactgattgatacggatcttctaaaaggcaaagatatcacaggctaccgcagcatccgcaaagatttaatcaatgccggtgcaaactacaaagatgcagaagtagtcgtcagccacaacattgtcacaagcagaacacctgatgatttggaagcatttaaccgcgaatctttaaacttgttaaaataacgagaaggcacagactgttcgggtctgtgccttttttaaaattaagactccttctttacattctgaaagacagcagtcgcgtcccacacattcaagccaaattgaccttctgaaaatgcggaatcatttgcatcaatcacaaggcgatcatctaaatagattttaaagcgatcgccctcggcctctgttttcagatgatacttttgattaacgtctatcggtgttttgtattcagcaatgacagaagcaacaccgttctcaaatttaaagaatttcactagatcatgctttgcatccacattggcaaggtaaccgtttttggcatctttgtcagagcgaaacattagtgctcctgcccctcttccgtttccatccttaatggtgatatcagattcataagtgaagtctgacccggatgctgaagacaagataaaggaatctccgtccgacctcccttgtttcccctcaattgtgtcggcccatgtgccatttacagtcgtccagccagtcatattggacataaaaggtgacgttccccataccttttttaaagggtgtatggttaaagattttacctttacgccgccatttgcagcatataattcaagccctttgcttgatcggtctgggagaataatatccgttatgacctgctttccgtcattcccaaatacttcaaccgaggagcggtcaacaaaaatgcgcatcttaaccttcccatttaccggcttcaatggggctgtttcttttccggtgttaaaggccggattaaaggtattgttgcccgactcgctccggtcaacgaacaatttggcgttccttcggtcatagccgaccttcgtaaattgattttcacctgttcggaccttaaaaccaaattcagcagctgaaccagggcttactttaaattctgcatttatttcataggcatctccagattgccccgctaacacattatgacttgcaggcgatatggtcagattcttccacttcttagaggttccgcgaatggtttccagctctttcaccggtgtttggaccactctaaccccttcggtaaacgctttcaattttaactctcttggaatggacgttgcacttctccatggggatgtcggaacatcattcgcatattgccaattgctcatccaccctaaccatagccggcggctgtctgtggatggaatatcagaccaggatacagccgcataaaagtctctgccgtaatccgtccagagaactttgtttggcgggttttcatttttaaaatgagttccatcaaagtcccctacaaaatattgcatgcctgatcctcccgagaccgctccgtttccgacactgacctgcatgacccatttcttttgattcggattgccgtctaccggaagctcaaataaatccgggcattcccatactcccccgtggcttccttgatcctgtccaaattcacttgcatacgtccactgcttcagattttttgatgtataaatgaggattcggtcaccggccgcaagcaccatcacccactttttttctttctcataccaaaagacttttggatcgcgaaaatcttttttacccgggtttggaatgacagggttgccagcatacttcgtccatgttcttcctttgtcgttgctataggcaatactttgcacttgatggccttcccgatcctgtgtataaatggccacaagcggcttctctttgcctgtttgaaaaccgcttgtgttatttttatctacaactgcgcttccagaaaagatcgtgcctttttcatccggatacagcgcaacaggaaggtgttcccatgtaaccaaatctttgctgacggcatgcccccaatgcatgggcccccactgaagcccgtatggatggtattgatagaacaagtgatattccccagcataatataccattccgtttgggtcattcatccagtttgcctccggtgtgaagtggtattgaggacggtaatcctcatcatagtagcttgaatcggctgcatctgccgaaaatgccatagtcaacagcagggtgaacatgatcatgacttgaataagtctctttttcatttgttccttcgctcctctcttcatgtttgaacactttcaagagagactgctgcgcaagctggtccgtttctggcaattctcctctgtttcactgttatccgaatgatttatatatgaaaagactgctgcagtttctctctctttccttcacacaccttatgctaagaatccagcccaatacccgagaatcccgatgacaaagatgccgcaaataatgagaagtggattcacccctttgcgaagcatccatgccaccaataacgttaatccgagaggcagcgcccccggcataatgctatctagcacgttttgtaccgtttgaacatctacttttccgctttcatccttaatcctggatacaacgattggaatgttgatggtggtccatttggacacgagagcccccataacaaataacccgagaatcgaagcgccctctgtaagcttttgaatgcgattccccgctaaatcctgaagaatctccattcctttcacatagccatactttaatccgtaatattttgtgcttaatcttatggcattcagcaagaaaaagaatagcaaagggccggcaatgtttcctcctaaagcaagggaggctcctagcgcagctaagacaggacgaatcgttccccaaaaaattggatcgcctacgcccgctattggtcccatcaaaccgattttcattccgcttatcgcttttccgtcaattcctttattgttcgccatttcttcttccatggctgccgtcacgccaaatataggcgctgtcagccacggatgtgtattaaaccattccaaatgccgctgtaaggcttcgtttcttttcgctccgggaccgtacaattttttgatcgccggtatcatgacataacaatatcccattgcctgcacacgttcgaagttaaaggaaccgagtaaaaaatttgaacgaataaacatgctgaaaatttctttcttcgttaatcgtttttctttctccattttttcttccccctcatcgtttaggcatcaagatcatcatcatcgtcatcataaacagcaacactgccactgtctgatgcggccgcgactgctccgtgagcgctttgtttttgcatcacctgctggtataaaagcgccagacagagaccaagggctccaaatcccactaagttaaaatcggtaaacgccgctaataagaaaccaatatagaaaaatggctttaaataaggaatattcatcatattgatcaccatggcatacccgactaccacaataatgcctccgcctatttgcagtccttttgtaatgacatcaggaatatttcccaggaacgcctgaacagcgctgacactaattaaagcaacaatcaatgtaggaatcatgacgcgcaaagcttgaaacaccatcgcggtaatatgcataatttcaattccttttatatttcccgcttttgcatattgatcagcgcggtggatgaaaaagacagtgatcgtccgaacaaaaatcgtcagcgcctgacccgcagctgctaaagcaacagcgacagcaatcccctcgccaattccttgatcagcggtaataactaaaatggttgagatgacagaggcgatcgctgtatcaggtgccatggcaagcccgacgttcatccagccgagcgccatcagctccagtgtgcctccaagaataattcccgtttttaagtccccgagcaccaagccaaccaacgtacaggccacaagcggccggtgtgtctgcccttcatccaatacacttgcgattccggtgattgctgcaatgattaacaacaaaataatttgtaatgaagacatattctcatccccttgattattttgctacgttccgtaaaatctgtacaaaatcctcactggcatctgaaggcagctgcctcaattccagtttcacgcccttgtcacttaatgtttcaaatgcctttatatcttgttctgtgacactgactgattttgtgatttgcctgcgatgattttcaaaacgcattcccccgacgtttacggttttgatcggtacacctgcttctataagagatacaatatcggacggattttcaaacaagagcattgccgttaccccttcgtagcgcggactatgaaatgcttttgccattttagaaaccgagacggcactcgcctttacatttgaaggcgcaacagaaaggatcagcgtttttctcatttcgtcctgagcaatatcgtcggagacaacgatgattcggtcggctgcatggacttttatccaccttgtcaggatttggccgtgaataaagcggtcatcaattcttgctaacacaatgttcatcataattcatcctctcttgtatcttgattggctgtttttactttttctaaatgttcactgcacacttgaaagctttgctgactcattgcttttaagttgttcagcaaatctttgagagccagatgttctctcaggcttaatacctccagcagaatcggcaggtttacgccggctgccatatccattctttgatcctcagcaataaaggaagctgccgcgttatatggcgtccctccaaaaatatcgactaaaaaaagcacttcatgttcttccgggatatccttgagcgcctgatgatatttttcttgcagcgtttgtattccttcccctttaaaaaacggcactgcaatcaggttattttcttcaccgaatatcatccctgaagattcttttaatgctatgggaaaatctccatgaccgctgataataactgaaatcatatctattgctcctttcctgttttgtacatccatatataatgcaaggatcgtgccaacacagttgtgttaagcgttttcattgttatttcagccaatagcaatttgttgtcgaaacacttaaaacgaaaaaaataaacctgtattaaaatggtgttccatttaatacaggttcatataaaaaaactgtttttaaaacagctggccatgcacttcttcagcaaatatggcggctataaataatttttcatcatcacttatgcgaagtccgagcttttcttcataaggggctaatgttcgttctgtcacgtacaccatttccttcagctgatcattgatctcttcttcctccgagaaagcgatcggattctgcttaattaccctttcaaaggcgaaagccgtgtgcataatgactttaatcaaaaccgcattattgaaaatgacccccagctcatcttgaacggtttgcagccactccaataacatttcgatcacatggtggggattcaagaagacaaggtattttttcaggctatcctcgcaaagctccctgacaataatatttgcttcgttcaatccattgctcaaggggatgcttccttttgtaatcgcctgttgaatcagcttctctccctccccttcaattaacacttctaaagatacatgcggagcattgattttagggtctttcgttccgactgtcgcaaggatttcatactctttttcgatttcttttatgctgttggccagtttaatcgatgatacggtcaatatgtgaatcggggtatcggaggccttgtttacgatcgtggttagaatgtcttccagctttttggccgttccgctgcccgtcgtgcagatggataccaatgccttctttttgccggatgccgctggctgacgctcccacagctcgataaaatccttcgtgaccgattgatagatcgcatgcaaatttaaattcaaatagttgacctttctgacagcatccagcaccattgaagtcgtaacattgctgatcgttttgatggaaatacctgtcttttcctccagcctgctttccagcattgcaagcgaccccatgtctaccagcattaaaacaccttcaccttcatcaacctgtttcattttttctgctacgcattcaagaatgtccgaaggtgaaacagaaagtggcatatcgactgctgcaatcggcgtgctccctagcagttctgtcgcaacttcaaccatcgaactcgccgtgctgtttccatgagcagccacgatgataccgactcttttgttctcctttaacgatttgatggaatggattaacatcgttaagtagatgacttctatttcaggaatagccactttaaaatattcctgaattttatctttaaaaatcatcgccacccgatattctttcacatgagtatcacgaatttcatcagtctcctgtgtattcaaaacatcaatttgctttcctcgctttaaaaatgcgtcaatatgcatactcaagaaataaataaacttgcggtcaaatgtacaatccagctcatgttcagctatttcttttaactgttttgtcatttgaatcacgtcatcttcaacgaatgtcagcaggttgtctttttgaaaagcttgatgatgaaaaaaacttctgacatgcaaatggacatcagtcaagatgtattggttaatatcctttttggataaaccttctttcataagcgttttcactttttcctcaatcaaatgatataagttaaatgaaaggtcttcgtcaatttttgttgtttcatcttctacaatcggagagataatagttgtaatattgacatattcagaaatggctttgcttctttgcatgtttttgctgctggacatccattcttgcttgatttcatcaggcagatcgcgaacagtcagttcaataacctcatttctgtcaaggttatgcaaaaatccgtgtgcgcaaactaactggacatttgatttcagctgtccgacattcccaaatttcgcagagtgaataagcgcattatagacatcgatatgcacactcagattcttcttaatccgctctgcttctttccctaataaaaacgtcgtcagatcgactctttctttaagcgatcgttcttcaagcgaaggaatatgaatggtcattgggattcttcgcaaaaacgttttcaatagtgcagaactcggattttctgtagtcgcacaaataaacaatacgttcgatgttcgtttatgttcagattctccaagcctgttataagaaccgctgtcaataaaataaaacagcatttcttgtccctcgggagggagacggtggatttcatccataaaaagaatgcccccattggcctgttcgactaaacctgccttatcctcggcagcacctgtaaatgaaccttttttgtgtccgaataattgagaaagcaataattgagggttgttgtagtagtctgcacagttaaatgtaataaatggtgcgccggccttcaatatgtcagagtaaatggcaaactggtaaattcggttcgcaaaaagggatttaccggaaccagtcggccctaggaggagcatatgcagaccgttcggcggataaaagacagctgcttttgcctgggagatcgctttcttcaaactcccttttgcccctatcataagctctaggggattcgtggaaatgtgttgatgattttgctttgaatttccggaaaacgcctgaaggtctttcacttccatcatctctgtatcccatttcttgttgaataatttttctgctatctcgactgggatgtatcttacaggaaacgttttaattttgatgacctttttggaccggacgagattgttcaattcaaagctgacattggaccgctccattttcagctgctcggcaatctcctttgctgaattcccttgtatttttaaaagatgatctaaggttgaatcatgaaaattatgcttgagctgatggtatattttatctattcttctcacgtctatcatcctttgtccttattagataagccattaacaagaatatttcgaaaatttatagtccgcgttgagattatctgctgatacacgtttaaaaaggtctctatagcagattgacaaaactggcttttatgcgtatatgtttacatgttgaatcatttgcatctcatattagtatgatagatgctcagttctcgagggccagtccccttcaaaagtaataatcagtaaacagtttatcattctcggggaatgtaatgatgtcaaaatcatcaatgacaaaaaatgaatcttatagatcatgacaaattacccaaatataaccccttaagttcgctcacaactaaaaagacgggcactctatgtgaccgccacagtattacaatttgcaaaacttcgtcatttttgcaaagttaaggaatctgtaagcttaaaaactttatctccgatatctctcgatttgatcccccctgtaggcctcaaacatagtgggtatgcaattatacaaatcgttaccgattaaaactagcctgtcagattgtccaaatgactttcctgttttactctgctattcaggtagaatcaggagtgaaaatagagccacaagacatgtaacagcacttaaaatagttttaaaatttaaaaataaaagtatctattcttttaaatgttataatatccgataaaactttacacatctttttattactggaggaaaataaaattgataggcaattctagcaaagacaattttggccagcaacagaaattgtctagaggccttaaaaacaggcatatacaattaatggcgattggaggtgcaatcggtacaggtttatttttaggttcaggtaaatccatccattttgcaggaccatccattttatttgcttacttgatcaccggcgtattttgctttttcattatgcgttcgctcggagaactgctcttatcaaatgcgggataccactcttttgttgattttgtaagggactatttaggaaacatggcagcatttatcactgggtggacctactggttctgttggatttccctcgcgatggctgatttaacggcggtcggcatttatacgcaatattggcttcccgatgtgcctcaatggctgccgggtcttcttgcgcttattatcctgctgatcatgaaccttgccaccgttaaacttttcggagaattagaattttggtttgcattgatcaaagtcattgccatactggctctgatcgtaactggcattttcctgattgcgaaaggtttttcggcagcttccggccctgccagcctcaccaacctttggagccacggcggcatgttcccaaatggatggcatgggtttatcctatcgttccaaatggtcgtcttcgctttcgtgggtattgaacttgttggactgacagcaggtgaaacagaaaatccccaaaaagtgatccctaaagccatcaatcaaatccctgtccggattttacttttttatgttggcgcacttttcgtgattatgtgtatctatccttggaatgtgttgaatccaaacgaaagcccatttgttcaggtcttctctgcagtaggcatcgttgtggctgccagtttgatcaattttgttgtattaacatcagccgcctcagctgcaaatagcgctttattcagcacaagccgaatggtctattcacttgcaaaggatcatcacgcacctggactattaaagaaattaacttcttctaacgtgccaagcaatgcgctgttcttttcatccgtcgccattctgattggcgttagtctgaattatttaatgcccgaacaagtctttacactgattacaagtgtttctacaatatgcttcatttttatttggggcatcacggtgatttgccatttgaaatatcgaaaaacaaggcagcatgaagcgaaagcaaacaaattcaaaatgcctttttacccattatccaactatttaacacttgcatttctcgcgttcattcttgtcatattggcactggcgaatgatacacgtattgctttgtttgtcaccccggtctggtttgttttattgattattttgtataaggtgcaaacccgcagaggacataagatgaaataaaaaaaagacaagggatactcactcccttgtctttttatatgtgtcaaacactaaattaaactttggtttcaaatctcattcacttcatttaagtgttaactcaaaccagttttgatgccgaaacctactaatattattccggtaattttttgaaacactttctggaacttcgagtttttcatccatttttttgcgtaatcaataatataaacaagaaacagaaaccacaacaccgctaataaggttagaattgaagctaaaatgataagctgctggtttatatttccgttcaaattgataaattggggcatgattgtaacatacactaaaacagttttaggatttagaatgttactgagtgatccttgcataaaggaagttttataataacgtttcggagaacttgccatattttttgcttgggattgcatgtcatctaacgaaaacatacttttagcaaaaaagctttttacacctaaataaattaagtatgccgctcccaaatatttgatcgttgtgaaaagaatcactgactttgcgattaccactgataatcctaaaatggcaatcaccgtccaaaaggaaagtcctgtcgccaatccgagaatgttataacggccggctttcggaccatacctaagcgtatttttcatcacaagcatcgtatctgcccccggcatgataaccatcatggcagcgatcggtatgtatgcgagtaagctgtgcattgttctctccccctttaaaaatcccctcaatcatatagtgactacaaaagtaactacttataaaagtgtatcaatgcatttggaataaatcaatatggtttgttaaaatagcgattactaaggcagcgattgctctttatattggaggatatatgaaagaaaatatgttagacattttaaaaaacctcaattttacagaatatgaatcgaaagcgtatttggcattattgcaagaatcacctttaacaggctatgccgttgccaaaaaatccggagtgccccgttctaaaatttatgaagtcttggaaagccttgtcataaggggagatgtttttgtcagtcatggaaatacacctcagtatgttccagtccccgcaaaagaactgattaaaaaccgccggctcaaagcggaagagcattttgatcaggctgagaaatattttgaaaagttcgagcagactgctaatgaccgggaaaacatctggaatatcaccggccgcagtgaaattcttgaaaaggtgaaggcttgtattttatctgccaaaaaaagaatcctcttagaaatatggaaagaggattttgaggagatagaatcagagctaaaacaggcggcagaacaaggcgttattgtcaccattattgcgtacggagacatcgtatctgatttttccaatgtttaccttcatgatatgagcagtgaaattacagaagagtatgacggacggtggcttgtctatagcggagatgattcagaagtagtagcgggcattgtctcacttggcaatgacagccgtgctgcatggacgatgcatgtaggtttagtcatgcctattactgaagtgatcattcatgatctgtacctcatggaaattctgaaaaagcatagagagctattagaagagagcttcgggaaaaatctcatccagttgcgccgtaaattttctattcactcagatttcaaaaaacattatttggaataatgtttggcatctcttaccccaaaaacaaggcttgtacaaaacaagccttgtttttttatgcataaaccccccatccccatgctgatttacttctctcttttaaaaaatgtgattctgcgcaaactatttttcagcctgccgcgtctatcctaggtaacagcctacgatatacgtatattcaaaaaggagccctttattgcaatgaagaaaaaacaaacaacaaaagcgttgcttgtcacatgcataactgatcataagcaagatttctaccggttggctttcagttatgtgaaaaatcaagatgacgcattagatattgttcaagaatcgataaaaaaagcgctgagctcagttgaaacggtcaaaaaccctgagacgataaaaagctggttttataaaattttagtacggacagccattgactttttgcgcaaacaaaaaaagataagagtgatggacgacgaaacgatagaatttttaagcaaaggaaaggaagaccattacaaggatactgatctccatgaagcgcttgacgaattgccgtaccgctataaaaccattattattttacgtttttttgaagacctcaaattagaagaaattgcggaaattacaggagaaaacacgaataccgtcaaaacgcgcctatacagagcattgaagctgatgcgcattcagttgacgaaggaggatctttcttaatggataagagattacagcaattaagagaagaatataaaaatgttcagattcctaaagaattggatatcattgttgaaaaagcccttcagcaagaaccaaaaaagaaaagaatcgtcatgtggccgacatcagcagcaatcgctgcagctattttattcactgcacttgttaatatcaacccggacgccgctcaggctatgtccaagatccctgtcatcggcaaaatcgtcaaagcgatcacctttattgaaatcaaagaggaaaaagaccaatcaagcattgatgtcaaaacacctgctttgtccgggctttctaataaagagcttgaaaacagcattaaccagaaatacttgaaagaaagccagcagctgtataaagagtttatacagtccacatccaaaaacaaaaaagggcatctcagcatctacagtgattacgagacggtcacagacacgccagatttactctctatccggcgcaatattgaaacaacacaagcatcttcctacacacaaagccgttatattacaattgacaaaaagaatgatattttacttacattaaaaagcttattcaaagatgagcgctatatcaaagtcatcagtcaaaacatcaaagaacaaatgaaacagcaaatgaaggaagatccaaataaaatatattggctcactgacgaagatgcagaaccgttcaaaacgattcttcctgatcagacgttttacattactgaagaccataaacttgtgatctcatttgacgaatatgaagtcgcccccggctatatgggcgttacagagtttacaattccaacccgtgtcatttcaaacttgctcgtgggagaacgttatattcgataaaataaaaacatccatctaagattatggatgttttctctcttctctattcgaggtcgtaacctcgctaccaaaaacaacgagaatatttgcatactattggaggaatacccatgtatcacaagacacagcatcatcgatacattcctggacttgatggccttcgggctttcgccgtcctgtcagttatcacttatcacctaaatttcaattgggctaacggtggttttatcggagttgatatcttttttgttttatcggatatttgattacatctattctattaccggcatatggaaatgatatcaatcttgattttcgggatttttgggtgcgccgcattcggcggcttatgccagcggcttaccttatgatcttttccactgttgtgtgggtcgtattgtttgatcgagaactattacacactgtacgtggagatgcgatctcttctctcttttatatgagcaattggtggtttatttttcacaagctatcatattttgatagtttcggttccccatcacctctaaaaaacctttggtctctggcgattgaagaacaattttatatcatatggccgatgttcttagttgttggaatgtacataatgaaaagccacgccagattggctgcggtgatatcattgcttgcgctttgttcagccgtgatgatgagcgtactgtatgaacctggcggagatccgagccgcgtttactatggcacagacactcgttcgtttgaacttctcatcggatgtgccttggctttggtatggccgatgaaaaggctgtcttccaacaggctgccaagcaaactgaagcacactttgcacgccactgaattttcggcattttgtattttagtgttatgtgtctatttctcagatgaatacgagccttttctttacagaggcggaatgctattcattagcgtgactgccgcaatccttattgcatgtgtttgccatccgagcagctttttaggcaatctgctttcatggaggccgcttcggtggcttggaacgaggtcttacggaatttatctttggcactaccctgttattgtgttaagcacgccagttcaagaaatcggaaaccctgttttttggcatatcgtgctaaaggtcattgtgacatgtatacttgccgagctttcctatcattttattgagaagccgatacggacacagggatttaggtcatttttccgccgtgtttttatacatagaatcatagaatggaaaacgacatctgtcatcagcaaactgtcaattggtttcgtcattttcgctatacttatttttgcaggagggctgtctgggttagccggagagcaaaagcaccctaccaaatggacctatagctcacaagaaacaaatgctgactccagccaggcttctggggataaaaagaacgctgcagcagataaaaaacactatcctgaacaaaagacaacagaatccgatcaacgtcaaaaggaaaacaaagatagtgggcaagagactcataaaaagaaagacacgcaatctcaacagacgaaaaaaccagcagacactgcgaaagaggtgttagctataggagattccgtcatgcttgatatttcttcacacctgcgtcagtcattttcaaatgtgacgattgatggaaaggtaggaagacaaatgtctcaagctttggaactcgcaagggagtacaagtcttttaatcagccgaacaaggctgtcatcattgagcttggaaccaatggctactttacaaacagccaaatcgaacaactgcttcaatctttctcaaaagcccatatctatcttgtcaatacacgggttccccgccaatgggaaagcaaggttaatgaatctttacagcaccaggcaagcgcacatcaaaatgttacgttagttgactggcatacagaagcccttcagcatccggaatattttacccctgatggtgttcacttggttcctaaaggggcaaaagctttgactgctcttattgttcaggcgatgaaatcgtaaaaaagagatcctatacggatcacttttttactttagtttctgatcgttgattatgtcttctttcagcaaggcagcccttatgtttacatgccgtttacgtaagggtaagccaaaattgaatggagggatgataatgaaaggaaatgaagaacatgacatccaaaaagagttgaaacgatatgagctttttttcaaaaaacgatataaggttctttatacattaaacgattttatcatcggtgctatgtttctcgttggaagttttttctttttctatgaccggttaatgtcggcagggatatggctgtttgcgatcggaagtttgctactgttaatcaggccgaccattcggctgattcatgactttcattaccgtaagcatgtggaacagcaattcaagcatcaatcttcaacagatgactgatcttaaggaataagaaagaacaaaatgccaaaagcctgagttgaaaatcaaaaacaagactttcagactatttatttttgaaaataaggtaaaaagaactaaacttttgcctctgcatgccgatatgaataataaggccggcgcgatactccctataacatccttttcagtagatttcattatcgtgccggttttctcatatgcaaagcaatcccgccaatcagattggcgggattttatattttacattcctgtccaaacgtcttttacataacgtttttgatcttgcagcttttgcagccattcagctgattcttcctgacttgctcctttttcagcttcatacgccaatcgcaaagttttctctacatcaggagccatttgcgatccatcaccgcatacgtaaatatgagcccctttttcaatgagtgtcatcaatttctgcgtatcttgcttgagcaagtgctggacatatccttttggttcgttttcgacgcgcgagtagcatcggcggattgtgaccaaaccgtcctgttccgcttgatccagctcttctctgtaaaggtcgtcatggtccgggcgacggcagccgaagtataaaagtgcttcaccaagggtgcttccttccttcttcaaaaccgatcttgcctgaataaagcccctgaatggcgcaattcctgtgcccggcccgaccataatcataggcgtttcaggctcatccggcatctggaatccggactgcggggtacgaatgaaacaggctgctgcatcatctgtattcaattctgctaaataattagaggcgacaccccggtattcacctcggccgctccatgctgaggctttcacaactcctaccgtcatgctcacgatatttgcatgaactttcggtgagcttgaaatggaatagtatctcggttttagtgatggcaaaagtgctaaaaaccgttcaaacggcatttcgcaagcaggataatcctctaaaaaatcaagcatggtaagacgtcttgcaagtacctgctctttgtaaatgccatcatctaaaacgagctgttccagctctttttgatgcggcggacagactgtataagaggccagctcccgaagctgaagccttgatgccggttcctgcagctctacataggacgacaataaatccgcaactttgatcggccgatccatcggcagatgagacatatgagcgcttccgcttacttttatcacatgattggactgcaaaccgaatcggctgagaacccgctgaacaagctccctgctgttcttcggcaggattccgatatgatcgccttctttatatgttttaccagccggaatttccaattcaatatggcgggttgaacgcgtgctgtcagctgtctggagttctcgattctctaacacaatcccttcaaaggcgccatatgctttagcaaccggcgtttccgtcgcttcactgagaaaagtaatcgataatgaaggcctgtcttctttctgggctatttcgttaatgtcaaatgcgtccattgtttccttccagaagcggttttcccaagactcgcggtggctttcaaaatcatcggcggcgtcaccttccccaatctctgttaaacgcgatgccccctttgctttcatcatgtcatcaatcaggcggggaatccgctgatacgtgctggcccagctccggtttccgcagccgaataccgcataggaaacacctttcaattggccttcctcaagctctttcagccactctacaaagccggcagcattatcaggcggcgccccattataagaagccgttacaatgacgactgcccctccttcagggagcttgccgatataatcatcaagcggagccgtttcagctgtaaagcccatctggcggccttgagcagccagttcaccggctattccctcagctgtcccaagatttgaaccaaaaagaacaagtaaaggtgtgccgtgtttaggtttggtttcttttggctttgtttctgctttgatgtctgcctgttcttttctctgtacattgattgccgctgttttccgcggtttcacagtaattttaaaatcatccggcttgatcgttaatgcttctttgatttttagttcgtagccagtatggtttatcaattcaaaatgctttaatacaagaccgagaaccattgtcgcttcttgaagagcaaactgcatgccaatacaagcgcgctgtccgtttccaaacggcttatacgcatggtgagggatacttgaaggatcctcaaaccgttccggacggaaatcttccgcatccggtccccaagcgttttgatcccggtgcagttttggaattaaaacagtgactggctgccctttgctgatcggatattccccgcctagaacagtatcctccttcgcatatagagaaaaagccggagctgttggatacagtctgagggtttcatttaaaaccatccgaatgtatttgagctgctggatttgtttatattcaggcgtgtcatccgttaacacgcgatccgcttcctcctgagcttttttcagtttttccggatgtgtaagcagacaataaatcgcaaaggaaagcaaaccgcttgtcgtctcatgtccagcaattaaaaatgtgatgatttgataccttatgttttcatcatccagcgtttcacccgttactggatctttggcataaagcatgagagacaagagatccttgatgttatcatccggattcgcctttcgctccgctatcattctatcgaccagggagttcatgacttctatatccttttgaaactgcagcttcgttttcaccatcatcttatcttgcaggcccagtctttttgattgattcatcgcctcttttaaggcacggagcatactggtgataaacggatgctgtgaatcacggtaaaagctgttgaatcgatagttaaatccgcataacccaatcgtatcaagcgtcagacgtgtcatatcgtctgctacatcaatttcttcattagggtttaaccggctccatttttgaatcagctgggttgcgatatccagcatcatagaatgatagcctttcatcgctttttgactaaaactcggcagcaaaatgcggtgggctttttgccagttcggttcgtgcgtccagcttgtaaataagccatctcccccgaattcgcgcaccttttgcaagcctttgccaaggttcttgtcaaagcggctttcatcacacacttcagccacaagattgtgacccgatacaaaaacactggatactcccggaaaatcaaaacggaaaatcggccccaattcatcagctatccgccataaggattgagaaagctgttctttttcaagatgcggaagattttttaaaggtccgtatgttttgggctgaggtattgcgcttgcctgtttcattaacatctccctttcctatttttgtgatgaatgaagcttaatggcgtcccagcagcattgttccaattcagtaattaaatcagtgtccatctctatatcacctgtttgaacgagctgatatatcttgagaaacgcccctaatacaatcgcaattaacacattagagggcaggctgcgaatcacgccttccgcttttcccttattaaaatagtcatcaagcatttgagtcagattttctatcatttttttgcttgtatgatttaagtaatgagcgtcttttttggtttcaagaaaaaaaagcgcatagtcgctctctttcgtaaactgaacgagacagcaaaatacgtggtgaaagccttctctgacaggcaattctgaaacgtcttgcttcagtttttccgtaaatcgctggatgctttcttgaaacagtacgttaacgagtgtttctttgctgtcaaaataacgatagatcgttcctgtccctacatgagcacgttcagctatcataggaatagtggtagcgtcaaaacccctttccgtaaaaagtgagactgacgctttcataatcatgtcgtatttactgctggatgcggatatcatgtaatctgacaacctccgattcgtttacggaatgaatattcattccttttgttcacaaagaatgtctgccctgtctgatatcacctctttgttctttcttctgttataagtttatatgaaaaaaactttttttaatataaagtatatgcaaaaaataaaaaattaagaaaatatacccaaatcctaatacaaggatcttggatatatttcccgagaaattttttatttaacagccacaatacatagacaggaagcacgcctgataacagaaagatccctgaaatgctggtctttcagcagttgaatatacgttttctctttttcaccggtatttgtgtcaatactgatataaaaccggccgtcaatttgaagcaccctgtaaatttctcttaatgcaagcctaatatcggtgcagctttgaaccgtatgtaaagaaaagactttattaaaggtacggtcatcaaagggaatgtcctctggatagccatgaaaaacctccccgttccccatgttctttcgattcgcacgtgatatctgtcttacctttcgctttgaaggatcaatgctttttaggcttcccttttctagtttcttggttatgcttttaaagacagtgccatttccaattccaatttctaaaattctgtcatttccttgtatatctatagagtcaatcatcatatgctcaattgttttggttagcttatatttccgagaaaataatttccaaaaattcgatcgtttatagagtctattttctagcattttaaacacctgcttttggtttcctatgtttatttattatattcaaaaaataaacatcatcttcattctaaaagtgaaggaaggtaccaactagacggcaatgtattgaaaaatgtttcaatagaactaaactttttcatttttttccgcaaaaaaagcagaaaacaaaatgttttctgccctctttctaatgccaatgataagggaatacatacagcctttgctgctgcattgccatcagcctctgctgtcggaatggatttccataaccatgtttgaaggaatgcggcatggacgcataaccatggccaatcgacggcagccttttttgataatcgttcatcatgccatcacctgcctcacagtaacgttgatttattgtatgcaggcaggcattttcttgacagtcatatcgctaaacttggtccttctccattgtataatgcatcaataattccattctaagcatatgccattcccccttcagtttttttcgttgcttttagcgccagtttgttaaataaagatgctttaactgagactctttcatttcatcataaatctgctcaatctgctgttctcgttcgaattcttccaggcttttaaaccgtttttttatcgttaacgttaaaaagaataggttaatcgtcatatcgctcaccccctttcaaagtccgcatcaagcgaaataacccgcggcacaccccttctgccgcgggcaaataaaaaccgcagacaaaagaagacaccaatgcctctactgcctgcggggagttgcgtatgtccgactattccgaatttaatgcgtgcgataagcatcggttaaggaaggacacgaactcttccacaggctgaataaaccatgaacttttacatgtgtatcacgtacaggttgacgtcgttgtctcattgtcattttggttcagcctcctttgctttttttcttactttgtaagtatatccaccaaattccattttgtaaacatctttttctaaaaatggacggaaattgtgcaaatcatcgaatggatttgcccgttggtcatgacacctgcttcatttcttttctggagcggtctttcttatgatatgcaataaaataaatgagaccgacaaatacagctccgccgatgacattaccgataaaagccggaatgatgtttccgatgaactgcccccacgtgaatgagcctgcaaaaatggcagcaggaatcacaaacatgttggcgacaacgtgctgaaatccgatagccacaaaagccatgattgggaaccagatgccaaggatttttcctgctgcgtcttgggcgccgaaagaaagccacactgcaagacatacaagccagttacagccgatggcggaaatgagaaccttgccaaagctcatatcaagctttccttgggcaacggcaatcgttttttctaaataaggacctgtttcagtcaatccaaccaaatgcccgaaaaagtacgcaacaaacaatgcgccgattaagttcataattgtgacgattccccagttaatcgctaactcttttactgatatttttctcgaaaataacgccattgcaactgacatcatattgcctgtgatcagttcagcgccagcgagtacgacaaggatcaggccgactggaaatactgctgcaccaatcaaactggacaggctcccccattctttcggaagatcgccgattaccctgatatcaagcaaatacccaagcgcgataaatgcaccgcctaaaaaccccagcacgagcagtgacggcagcgggagctttatttttttcatccctgcttcaattgctgcttccgctatttcatccggttttcgaaaagccataataaaacgcctccattacttcttcttttctcacagttatgcaagaaaggcaataaaaaaggcagcactcaaataacctgtgtcaaaccaggcgtttgaatgctgcctaacttgtatgcatacccatacaacaatatcaagcagtatgaagatattgaaagagaatatatacagttcgtgcatacattccattgctttagccttctataactgtagcaacatcatatcaaatgtgacaaatttgtgtcaatgacaaatatactagctttgcagaacttctttttgctcatctatttttcggtcaaaaacaaatacagatacagcgatgttttcctcaattttaatatcagaaaacaaatggactagcttagctcccatgagttcctccattccttccggtgtttgtttggaataaaggtcttgaattaggcttgtccgggccgcatgtaccatctctcttccttcaggcgtgcgggcgataaactgctcgcttgcactcagatttccatatagtgttgaaactgccatgttttctacaaatacagtatgaattctctcaggcccttttccgaacaattctttgcgaagttttcgaataatatcattgaattcatgaatttttttagacatgctgattaccccttccgatattgccttataaaggcttttcccggttcccctcaggacatttcacttggttaaaattttcctgccatattgtattataataaatatcacattataataaaagcagtgttgatggatttgtaataggatcttgttatgagtctatcgttttataaaaatcaaggattggtctgttagtaagacttgctagtgaactattccgccatgtgtgtttacaccttcttagaattaagggcaggtgtatctctatacatggctttttttgacttcttgaaagaaagatggaggggaatatgaatatgatggacgttaagtcgatcagtgtccgtgtagacggaacagaaattcaagcacgagcaggggccacaattttagatattttaaatgaaaacggaattgagtacccgcagatttgccacgtaccagaggttgacccgattcaaacttgtgatacttgcatagtagaggcaaacggcaagctggttcgttcatgcgcgaccgttgcagaaaacgggatgtctattgatctttcaggaaatcgagtgaaagaagcgcaaaccgaagcgatggaccgccttcttgaaaatcatttgctgtattgtacagtttgcgataacaacaatggaaactgtacgctgcataatacagcggaaatgatggggatcgagcatcaaaaatacccatacacgccaaaagaagatccttcttgcgcggttgatatgtctcatcctttttaccgctatgatccaaaccaatgtattgcctgcggccagtgtgttgaggtctgtcaaaaccttcaggtaaatgaaacactctcaatcgactgggagcgcgaacgccctcgcgtcatttgggatgagggagttccgatcaatgaatcttcctgtgtcagctgcggtcagtgtgtcacagtatgtccatgtaatgcactgatggaaaaatcaatgctcgggcaggctggttttatgacaggcattaaagaggacgtcatggaaccgatgattgatctcgtgaaaaatgttgaaccggggtatggcagcatttttgccatttctgaagtcgaagcggcaatgcgtgaaacgagaacgaaaaaaacgaaaactgtatgtacgttctgcggtgtcggatgttcatttgaagtatggacaaaaggacgggatattttaaagatccagcctgtttctgatgctccggttaacgcgatttccacatgtgtcaaagggaaattcggctgggattttgtcaattctgaggagcggatcacaaagcctttaatccgtaaaaacggagcctttgtggagtcttcttgggcagaagccctcgatcttgtcgcaagcagattaggatcaattaaagagcagtacggtaaaggctctgtcgggtttatttcttcttctaaaattacgaatgaagaaaactacgtcattcaaaaactagcgcgtcaggtatttgaaacaaacaacgtcgataactgctcacgctactgccagtctcctgctacagacggattgttccgcactgtcggcatgggcggtgacgccggcacgattaaagatattgccaaagcaggcctcgtcatcattgtcggtgccaatccggcggaaggacacccagtgctcgcaacacgcgtcaaacgggcacacaagctccacggtcaaaaactgattgttgctgacctgcgtaaaaatgagatggctgagcgatctgatctgttcatcagccctaaacaaggcacagaccaagtttggctgatggctgttacgaaatatatgatcgaccaaggctggcacgatcaggcgtttattgatgagaacgtcaattactttgaagattataaagaaacccttaaaacgtatacgcttgattatgcagaacgcatcacaggcctttcaaaagaaaacatcattcaaattgctgaaatgattcgtgatgctgacggcacttgtgtcctttggggaatgggtgtcacacaaaatacaggcggttctgatacatcagcagccatttcaaacctgcttctcgctacgggcaactatcgccgtccaggtgccggcgcttatcctctgcgcggacacaataacgtgcaaggcgcatgtgatatgggaacattgcctggctggctgccgggatatcagcatattacagatgacaaggcccgcgctaaatttgaagaggcatatggtgtcgagattgatggaaagcctggtttagataatattcaaatgcttcatgccattgaagaaggaaaaatgaaagctatgtatcttgtcggtgaggatatggcactggtcgattcaaacgcgaaccatgtgcatgatattttatcaagccttgatttcttcgtggtacaggacatctttctgtcaagaacagctcaatatgctgatgtcgtcttgccggccactccttcacttgaaaaagacggaacatttaccaacacagaacgccgtgtgcagcgattgtatcaggcgcttccgacgcttggtgacgcaaaaccggactggtggattattcaagaggtggcaaaccgtttaggagcgaattggaattacagccatccaagtgacattttctctgaaatggcgagtctttctcctctgtttgccaaagcaagctatgaggtgcttgaaggctggaacagcttcctatggggcagcttcacaggtgaaagcacaccgcttctgtatgaagacggatttaatttccctgacaaaaaagcccgctttgccctttctgattggaccgagccagcggcatttccggaggaatatgaccttcatatcaataacggccggatgctggagcatttccacgaaggaaacatgacaaataaatcgaaaggcatccaagcgaaagtgccgaatgtattcgttgagatctcacctgagcttgcacaagagcgaggtgtttgtgacggttcgcttgtacggctcgtttctccgttcggagcagtcaaattgaacgcgctgatcacagaccgggtacggaaaaatgaactctatctgccaatgaactcgacagacaaggagtcagcgattaacttcttgacgggccctgcagctgataaacggacgaacacgcctgcttataaacagacaaaggtccgcatggaagtgcttggcggctgtgaaacagcgccgcttccaaaaacaaatccgcgcaacaaaaaacggcatccgcaaaacggagtcgaagcagaaagaaaatggaaccgccctggctatgtacatctgactgattaaacgataggaggaaaacgaatggccactccgattacgacgatcaaaaaagaaacaaaaacagctgagcaaatgaagcttgaaaaaatagaagaactgaaagagctgctggcggaaaatgaggacgccgtctctaaaacgatgacgttaatgaatgaactcaatgatcttggaatttttgatgcggcaacaagcatgctcagagcgaaggaagacattgccaagattgcgcttggccaagtttcccgcgagcctgtcaccaacctcatcaacacgatgatggccgccggaggcgcattgacaaaagccgatcctgagtttacagcaaagcttttagaaagcgtaatggctgggactgaacaggcacaaagctttttaaaagaagacaagaaagtcgggattctcgacctgttaaaagcaatgaacgatcctgatatcaacagagccgtcggcttcggccttcagtttttaaaaggcatgggaaaagaacttcgagaacaataacagaaaaacagccatcgctgatgatggctgtttttttattcgtcggcttcttccaaacgcttcttgtaaataagtgaacggtcagcgcaaaagaaggcaccggctaaaaatacgcaatccgctaaaaacatcgtcgatttctggcctaatgttaaaccttgatcagggagaactgcgcctatatataaaaaagtgctgactgcaagcaatgtaaaagcaaaatgcttgtagtcttcttttaaagatttcattctatttttgttcaaaagaatcacctgccagattcatagtatacgactattataatataatccggcggcttacagagaaagtaattctatccatttgttatatattttcaagcgcttggccgatatcttccaacaagtcttccgcatcttcaattcctacagaaattctgatcaagccgtccgtaatgccgagctcaagccggcgttctctcggaatagaggcatgtgtcattcttgcaggaacagaaattaagctttcaaccgcccccaggctttcagcaatggtaaacagtttcagatttcctaaaaacgcatcaacccgttcttcactgccaatatcaaaggagatcatgccgccgaagcccgctccttgcgtttttgcaagctcatgtccgggatgatttgaagaaccagggtaatataacgtttggacagcagggtgattctcaagaaagcttgcgattttccgcgcattttgatcgatcgcttccattctgagtcccaacgttttgattcctctcattaacagccaggaatcttgagggccgagcacgccgcctgtggagttttgcacaaaatgcagctcttctccaagctctttcgaagctgtcacaactaaacctccgacgacatcactgtgtccgccaagatattttgtcgcactgtgcagtacgatatcagcgcctaaagtaagcggctgttgaaaataaggagtattaaaggtattgtctacgataagcagaacacccgctttttttgcgatatcagccatgagcgtcaggtcggtgattttgagcaacgggtttgtcggtgtttcaatataaattgcttttgtattagggcgaatcgctttttcaacttcttccctgctgctcgtatcaacaaatgttgattcaatgccaagacggttaagcacctttgtcatcacgcgatatgttccgccgtacacatcatcagtcaacacgacatgatctccgctgttaaacagcatcataaccgctgtaatggcagccattcctgagctgaacgcatagcctgcttccccgctttccagttctgtcacaagtgcttcgagagcggttcgagtcggattggccgttcttgaatactcgtagcctgtatgctgccctgctttcggctgcttgtacgtgcttacttgataaatcggcacggaaactgcgcctgttttctcatcacctgtgattccgccatgtatcatcaatgtttttttcttcatatcagatgcctccttcgtatatttgtttgctgatatatcgatcgctgctgtcaggaaatactgtgacaatgttagttccagcggatgcttttttcgcttcctccaatgccgcataaagcgctgcacctgaagagcttccgatcagcaggccttctttttctgccgcttctttcacaagtctaaacgcattctcatctgttacggtgtagatctcgtcaaaatggctcttatccatataatcggggataaactccatgccgatgccctctgttttatgagcgtggggctctcctccgtttaaaatcgagcccaccggttcaacaatcaccgttttgactgctggatttttttcttttaagaaggaagctgtccctgcgaatgtgcctcctgatcctgcccctgcgacaaatgtatgaatattcccatcaagcgcttcccacatttcaggcccaagcgtcttatagtaagtcgatggatttactcggtttttaaattgcaaaacgcaataagaattttcaatttcagtctccagctgaatggctttttgaatggcgccctgcattccgtcttgacgcggtgtatgaatgattgatgcgccaagcgcttgcataatttgctgtttctctctgctgaaatgttcagggacacagaaaatcgctttcagcccatattttctggcactcagcgcaaggccgatccctgtattgcctgccgtagcttctataatcactccgccgggtttcactttgcctgaatcgagcgcgtcacgaatcagcatatctcccagtctgtctttgatgcttccccctggattcatcatttcaagcttggcatacaccgccactccttctggaacatcaaagttcttcaagcggagaagcggtgtattcccaatcagctcggtaatgtccgtaatcactgtcatatatgtcctcctccttattagagggtgtttttagaaaaaacggaggagaacattctccccgttttaatgaattcgtttgatcacctttaacacaagctctgttgaatggacagccgcctgctctaaaaattggtcaaatgaaacatgtgattcttttcctgcaatatcagataacgctctgatgacgacaaacggcgttttaaattgatggcacacttgagccactgccgcagcctccatttcaaccgcatacaaatcagaaaatctcgtacgcacctcttcaacccgcttcggatcgttcatgaaagaatcgcctgttgcaatcgttccttttgcaacctgaatgccgtcgagttcagataccgcttcttcagtgatgctgatcagcttttcatccgccgcataagcagccggaagacccggcacttggccgtattcatagtcaaaagccgttacgtctacatcatggtggcgaacgtcagtggaaatgacgacatctcctacattcaatgtatgatgaaatccgccggctgagcctgtgttaataacataatcaggcttgtaacggtcaagcagaagcgtcgtgctgatagcagcatttacttttccaattcctgattttaaaagaaccacttcagttccttcatattcgcctgttgtaaattcacagtgtgcgatcgtttctgtttttgcattttcaagtttgtttcttaagatggtaacttcctcttccattgctccgatgactgctagtctcatctattcacattcccttcactttaccgtttgatcgcctccattatccacacgaagtcgttttgctgagtgaatcggactgcaaaaccttcagctgtaaacatttctttcaacgcatccaatgtaggataatgctctgtctctaaatcatttgcaagctgataaaagccttgagaacgggctttatcgatagcctgttgatacgcttgcgcatcttcaaagacggtatcggcaaacactattttatcatgcaagtgaaggtatttgccatattgctttatggcagcccgcttttcttcgtcagtcaaatgatgaaaagcatatgaactgacaattgtatcagcctgaaatggcggctcagggaatgtcaggaagtctccatcaacgatttccgacctgcctgaaagcttgtcagaagccagtttacgcattgctggagaaggttcgattccaaatacagttttgcctgcatcgagcagcttagccgtcaaattccctgtccccgggccaaattctaacacatgcgttccagatttgctgacgatggcatcaaggatatgatcatagcctctgaacgcttctttatactgaatatctaaaccttgtactgtttgatcataagttgctgcccaatcttcaaagagagggataaattcacgtcccatatttgtcacactccatatttaataattcctataagcatactatgaattaatgatggaacagttcctataataccacatcttctgaaaagcaggtactaaaacactttgtgtattttatgccatctcatattgcgcattgaccgcaaaaaagcttatacttcaaatgacttgtgaaagctggagggtcaagatatgaattttcaattagatctgattaaagacaaagtggaattttttgaagcggcttcattgcaggagcttgaaaagaaaatcaatacacaaattgaaaacaataaagccatcatgctccgggtgaaatctgtttcacaccaaactgctgtggcagaaggaagaatattgtacagcgcggtggttcatttcgcagctgaagcctaaaacaaaagcagccggttctaacccggctgcttttgtttattttagcttttctacttttgtcggcttccagccttttttatcaacccatgtaatcgtgacttgatatttattcccagtcgccttgtccaaaatcttgcctttagcatcctgagggctgccgttatttccaagccagagcaccgtcatgttatctgttgagacaccagttgcgtatgaaatggctttcagcatctcagcccagtcttgtgagcttgaatcataagtagcggcatgctcgccagcctgctcagttccgactgctttccagtcaggattttcatacgttttttccacatcgctcgatgagccgccttctgttacttttgcatctttaagcccgtcaccggctgaatctgagcttgaatctgaatcagagtcatcttttttagaagaagaatcatcttttttggaatcagagtcagaagacttctcagaatccttttcgctgtcagatgtatctttcttgctgtcttttatatcctcatccgatttcttttcagtctttcctgaagccggagattcctgtttttgcgccgtttcagaatccttgctgacatctttgctagaaggactgttaatgaagagattcgctgctactacgacaattagtatggatacgattgcgattaaaatgttaagcactaaattggcttttctgcgtttatcacgattttcataacgagattgattattgctcaataattctgcactcctttatccctcttggctcagcatatattttaacatgtgctgagaagttgttctatttctgattgatttcaatttcgtgtacttttttaacaatatcataaaacaccgaatttgtcagagccttatctcccggtgtatccatgtgtaaaacaaccagagcgtatttcggcttatccgcgggaaaatatccggcaaaccatttttcatagagcgtttccctctcttttgaaagcttgcctgtttgggctgtgcccgacttccctgctacagtatacggaagatcttgaaaccttctgcccgttccggaaggagattctaccacccgccgcagtattttttgaagctgctgtgacgtatatttgtctatcgtttcccctttgagcttctgatctttaaacgtaacgagcgttgtgccgttcttatactcaatttgttcggcaattttcacctgccgtttttctccgccgcgggcgattgtcgccatcatattggctacctccagcggcgttacctttacgtttttctgcccgattgctgtttgcgcaatggcttttttgactgatttgtctttttcatccccccaaatcacgccgcttttttcgttatacagctggcggaaatcggtttcgtggtacagttttccctcccagcctgcccgatcagtgagagccagcttctcggacatatcttcaataaccgagctgtcttttttcattaattgttctgcaagactcgtaaatgtgtaattacagctttgggcaaaactttcatcaaaagacaaggttcctttgtcgtcccccggttccccgtacaggtttaaattgcaattaaaggtttgactaggcttcaccatattattttcgattgcagctgcggcaatgactgttttaaaaactgatccgggatagattggcgtcagcatataattttgaagtgtgttttgccgggacacatctgcatctggtttgcttacaatccccagaacactgctattttcgatgtccagcagcacagctcctccctttttcagcccctgttcatccaatacctcctccatcgctttttgaatgctttgatcgatcgttgttttgacctggagcggataaaatgtattggcttcagctgtatatttgacgtccatgccaaacaaagggtttccttttccgtccacatgatataaaagctttgtgtcttgttccggaagcaaaaactcgtcaaatgtccgttctaaaccggttgttccgatttctgttgtaatcggaaggctctccttgtcaggatatttcttgcgaagcagcgccggatcttggttcgtgctccctatcgtatgtgaagcaaggctgggcttgtcttcattctccatatatacgccgtaaatgccgggatatttcaaagaattgatttttgtgatagattgttttgaaagtgttttgattttcttttgctgcaaaatgaccggtttttttgcctgacctagtgtctggcgcaaatcatcttcagacatgccgaggatgtccgcaacttttttgatcggccaatcctgcgtcagcagaaaagggaacaaaacaaccgcaggctcgctttgtcctgtcagcgcccgcccgtttcgatctaaaaaagagcctcttccatctgaaatgagcacttcctccgtccgctgtttcacactttcttgaatcaaattaattttctttttagaaaatgattctgtgaaaaacagctggatttctgcaagtctcagcagaagcagaaaaaatacaatcaaaaaagcgatgactgccagcttcattcgtttcgatatcttcataaaaaaaacacctcacccacattgtggacgaggtgtttcgctgctaaacagatattatgaaattttcacaattttcacgagcatttctccgcccggtgtttgtactgtgacttcttcatctacttttttgcccaagaggctttttgcgatcggtgaatcgtttgagattttcccttcaaacgggtcagcttccgcgcttccgacgatcgtatatgattcttcatcaccgtcaggcagttcgacgaaagtgacggttttacccaaaccgacaacgttagagccgccgtcatcttcaatgattttcgcattgcgaatcatattttcaagagtcgtcacgcggccctctacaaatgcctgctcttctttcgctgaatcgtattcagagttctcggaaaggtctccgaagcttctcgcaattttgattcgctctactacttcttttcgtttaaccgttttcaaatattctaattcttgttcaagtttttgttttccttctgcagtcataggaaaaactttctcttgtgccatgtcccttcactccttctggttgtccctcaacatcttcgattatgtatgagagcataaactaaaaaatacaagaatgagaacacagggcagtcctcgttcttctctcccatataggtactgtttatcttaaactgaatcgtgtcgttctgcaaatatttcgcgtttataaacagggaaagaagggaattcgcacattcccttcctgcctatacataatatggtcagagttatttatgtctatgctatggtattacaaaatcgcgttttgttcaagaatggtttgaatttttgtgaccatcagatcaattgcgacgtgattctgaccgccttccgggataataatatcagcgtatcgtttcgtcggctcgacgaattggttatgcatcggacggaccactgacacatattgttcaatgacagaatcaatagagcgtccgcgctcattaatatctctcataatccgtctgatgatacgcaagtcagcgtccgtatcaacataaagcttgatatccatcagatcacgaagccttttgtcttcaagaacaagaatgccttcaaggataataacatcctttggctctacgtgaaccgtttcttctgaacgtgtgtgaagcttatagtcataaatcggcttttcaatcgggcggtaattcaatagatcttgaatatgctcgattaaatagtcattatcaaacgcaagcggatgatcatagtttgtgttcagcctttcttcaaacggaagatggctttggtctttataataaaggtcctgctggatcattaaaattgagtgtcctttaaactgttcataaatggaccgtgtgacactcgtttttcctgaaccggaacctcctgcgattccaatgactactggattcttacccatgggctgttacttcccctttctcatcatgttgctcggataaatctttttgtctagtttgaatttgacaatttgcaggggatggcgggcagcatctagctcatttccgtcttcgtcccaaatggtttcaatcgtatgtgtaaagttttcgatttctggaccgaaaaattccacttcgtcgccttttttgaagaaattgcgctgctgaagcgtgaccatttgtgtatcttcatcataattcagcactaagccgacaaaatcatatgtcgttttcttggcgtgttcgccgaacatttgctcttcatagcctggcgttccttcaaagaaagctgtcgcagtgtccctgttggcgcacttatcaagctcttcaagccattctttttgaatcacaaagttttctggatcagcgcaataagcatcgattactttgcggtatacgctgacaacagttgctacatagtgaatggatttcatgcggccttcaatctttaagctgtcgatccccatttcaatcatttttggaatggattcaatcagcttcaaatctttcgggctcatcgcaaatggtgcatcttcttcaccatacaaagcaacggcgttggcaccgtctgtttggtagagatcataatcccagcggcatgactggcagcagcctccgcggttggaatcccgcgctgtcatgtgattgctcagcacgcagcggccggaatatgcaatacacattgcgccatgaatgaaggattcgatttcgatatctaccttttctttcatttctctgatttcaagagcgctagtttcacgtgccagcacgacgcggtcgagaccttcttccttccagaactggacagccttccagtttgaaagagactgctgtgtgctcaagtgaacctcaacattcggcgccactctgcggcatgtttcaataataagcggatctgccacaataataccggcaacgttggcgtctccaagcgcttttaaatagtcttcaagcccgtccatgttttcattatgagcgaaaatattcgttgttacgtagatcttcgcgccatatttctttgcgaattcaacgccttctgcaatttcttcgatcgtaaagttatcggcattcgagcgaagcccgtattcctgtcccccgataaagaccgcgtccgctccgtaatgaacagcgattttcagcttttcaagattacccgcaggtgcgagaagctccggctttttcgtaatcacacgctttccattaacgattgtggatattttatcatttacggcagtcatagcttaacctccttttgattaataaaccgtttccttgaagaagaatccggtatcaatttttctgtttactggctggatgctttcaatgcgttcgatccagtcttcttttttcgcttcgtattcgtcacggttttccacgcacaaatcaattgcttctctgtacattttggtgacttctattaggtattcaggcattttcaaaacaccatcgattttgaaagaatcaattccggcatctatcaattcctcgagctcatcaatgatgcacacatcgttcgggctcatgatgtgagtgccgttttcatcttcgaaaatcggatatttattatcgcgttctttatcgtgtaaaaacatgcctgattcttttttctttctttcaatgtccatgactttgccctgatattcaaaatagtttccaatcaaagaacgcttcgattggaacatgcacgtcattccatgcacctggatttcaatttcgacttcagcattttctttaatctcaacaatgctgtccatgtttaattctctggcaagcacagaacgcgccgcacccttgcgtccccagtagttgcatgtataatagttggtgcctgtcgtttctgtgctccaatgaagcttcagatcaggcgcagattcacgggcagccatcagcacggcaggatcgccgaataccgctgcatcgacaccggcttctgctaagaaagccagatattcgccaagctcacccactttatcattatggaaaattgcatttacagcaacgtatacttttgccccttctttgtgagcaatctctacggcttttgttacatcttcacgagaaaattctccggctaatctcaagccgtatctctgttccccaactaaaaacgcagttgccccagcctgtatgagcggcaaaatgtccgctgtactcgtcggcgtcactaagagctctggttttttcatgacgttcacctcttctttttactaatcgcaagtccgtccccgacaggaataatcgcagtttgataatccggatgattcatcagccaatgattatattcatcaattttggctacaagcctgcgccttctcttcggttctattttgctgtaatcctctgccaccagacctttaaacagcacgttgtctgttataatcaccccgtccggtgaaagcatcggttcatataaatgaaaaaagttttgatactgaccttttgcagcgtcaataaaaatgacatcgtaaggcgcggttacatgaacggcgtcggctaattcaagcgcatctccgtaaaaaacatgaatccggtcatcaagctgaaattccttgatattgtttaccgcttcttcatgccgtttctcattgcgttcaattgtatatatttcagcagacggcagttccagagccattcgaatggctgaataaccaatggccgttccgatttctagtatttttttcggctgtttcacagacaaaatttgaagcagcacctccatgcccgctttttccataatcgggacatgatgttcttctgcatatgcttcaagtctcttcacgttatccggccgaggctttaataatgcttctatatagtcatttatttgttcataccggtcagtcactacaaacagcctcccgttctaaaaaggagtgccccagtcttatgcgcaggacactctctgaatacatcatgatacatcggtaaacaacccgatatattttatcataaaaccttgcggaaagcgaacaaaaggagagctttttgctctccttttatttctcattttttgaggaaatgtatttttcttttgctttattatgctcttttagcgtttttgtaaatacgacctcaccatttgatttggccaagaaatacagatagtccgttttatccggatgcagcgctgcttcccatgatgacatgccggcattggcaatcggccctggcgtcagccctgtgtttttatacgtattgtatggtgaatcgatttccagatccttataaagaacccgatctttatgcttgcctgccgcgtacaggacggtcggatctgtttggagcggcattttctttttcaggcggttataaaagacgctcgcaattttatggcggtcggctttttcagtcgcttcttcttctatcaaagaagccattgtcagcagcttatgcacagaaactttgtttttcttcatttctgatttatatgtttccacataagaatttgtctgcttaatcattgccttgataatgtcttcaagtgatgtgtccggatcgttaaaagggtatgtagccgggaataggtacccttcaagcgggtgcttaatgtttttattgaaaacatcatttgtcacagtgtccgggaattctttcttcagctgattgataaatgtttcatcgtccagcttcgctatgacttgttttttagagtattttgtttcatcagcaatagcagccgcgatttgggtcagctgtgctccctcagtcactgtgatttgaaaagcgtaacctgtagccccgcttgtcagcttctgaataatggcatctaaatccatacctttattcagatggtagaatccggcctgaaacccggaagcacctttatatttcacatagtactgaaacgccttctcgctttttatgacatcatttttctttaatatcgatgcgatggctgaaacagacgaaccgctcggaatgttaatattaactgtcgttttactgtctttttcaacaggttcaagcaatgatttcccatataaaaatgccccgccaatgatgagaaacagcacaacaatggaagacagtatgattctttttttattaaaaaacgattttttttgctgattgatatacattaggtctcctcccatcagctcttatactacatgattcattgtatttcggcaatttattacaaaaagaggcctgcataaagcagaaaaaagccggagcagtatagctccggctttggtttggcgcgatgttttactcttcgtcttcgtccgctaagaatgtgtttagtgtttcttcgatcatatcccattcttcgtcagtttcaatcgggaatagctcaccgttttcaccgtcttcgtttggcgtgaagctggaagcaagaatttctacttcttcgtcatcttttgattcgattggatagtacaagacataagatttgccaaactcttcattttcaaatgtaaacagcacttcacaaagctgttcatttccttgatcgtcaacaattgtaatatttttttcgccgtgttccattttcttcacctctggctttaatttaagctgtcaagatatccttgtaaaatcataacagccgccattttatcaatgactttttttcgtttttgcctgctgacgtcagctgcaatcagcattttttcagccgccattgtggtaagacgctcgtcccacagcacaacaggaacattgtacgttgtttcaagcactttcgcaaatgtttggctggcttcgcctctcgggccgactgttccgttcatgttcttaggaaagccgagcacgattttatctatagtatagtcctttatcagttcagataaacgggataaaccataatcgccttctgcttcatttatctttatggtctcaatgccttgagcagtccagcccatttcatcgctcagagctacaccgagtgttttggttcctaaatcgagtcctaatattctcattctttatttacgcctctttatgctgttctaaataagactttaccaattcctcgattaattcgtctctttcaagtttgcgaattaaattgcgagcgtcacgatgcctaggaatataagcgggatcacctgacagcaagtatccgacaatctggttgattggattgtagcccttttcctgaagcgcgtcatacactgtaatcagcacctcatttacgttagtctcagcagaatcatcggagaaattaaatttcatcgttttatcaaacgagctcaccgttttgcacctctttcccaaattcgcaggcaaagttcagcctggggtcctaatcttaccatcattctacactacatgggcgaattataaaacggatttcacccaatcttctacagaagccaaagcttcttctaatttttccggctgtttaccgcctgcctgcgccatgtccggacggcctccgccgcctccgccgcaaacttccgcagcttgtttaaccagcatgccggcgtgaagtcctttctcaatgaggtcctttgtgactccggcagagatattaactttatcgttttgtaccgcaccaagcacgatcaccgcagagccaagctttgctttgagttcatcgaccatagtgcggagatgattcatgtcttttgcatttacttttgccgcaagcacgtttacgccgtcaacttcttttactttcgacaggattgctcctgcttccacgttgcctagttttgcaagaagagattcattttctctttgtgcatccttcagttcagcctgcagagccgcgacccgtttcggcacttctttgatatttgttttcagctcgtcagcggtctgcttcaatacagaaatctggctgttcatttcgacgtaagcgccttgtcccgttacagcttcaatccgtcttgtgcctgctccgattccggattcagaaacgattttaaacaagccgatttctgctgtatttctgacgtggcagccgccgcacagctctaagctgtaatctccaacttgaacgacacggacaatatcgccatatttttcgccgaacagtgccatcgcacccatttcttttgcttcagcgatcggtttcaaatcaatgctgaccgggatgctcgcccagatcttttcgtttacgattctttcaatttgttcgagctcttcttttgtcacttggccaaagtgcgagaagtcaaaacgaaggcggttttccgttacaagagagcccgcctgattgacatgagttccaagaacatcttttagagcctgatgcaataaatgcgttgccgtgtggtttttaatgacgccgcttctcatatggtcttcaacttcagccgtaacatgcaggcctttttgaacagtaccgctctccacaacaccttcatgcacatgctggccgttcggcgctttttgaacatctttaattcttacaactgcctgctcgcttcggagatagcctttgtcgccgatttggccgccgctttctgcatagaacggtgtttcatcaagaatgatttgaacgctttctccttcatgagcctcttcgattaattggccgtcctgaagaagcacaatgatattggcatcagctttggtttgagagtagccgacaaatgtgctttcaactgtcacgtcgcgcagtgcgccgccctgcacctgcatgctgccgacatcctggcgggcgtttcttgcccgttcacgctgctggttcatttcctcctcaaagccctcatggtcaaccgtcatgttctcgtcttctgcgtattcttcagtcaattcaaccgggaatccatacgtatcatacagtttaaacacatcagcacctgagataacgctgctgcccttgtctttttcttttttgatcatttctgacaggatcgcaagcccttcattaagggtctcatggaagcgttcttcctcggttttaatgacttttgcgatgaaatccgctttctctttcacttcaggatagaaatcagccatgatttctgcgacaaccggcactaaatcaaacatgaacggacgatggatgttgatcgttttggcataacgcacggcacggcgtaataagcgtcttaatacatagccgcggccttcatttgacggcagcgcaccgtcactgacagcaaaggcaaccgttctgatatggtcagcaatcactttaaacgcagtgtctttcacattgtctttgccatatgtttcaccagaaatcgattctgttgctttaatgatcggaacaaacaaatcggtgtcaaagtttgtcggaacattctggatgacagacaccattctttcaagacccatgcctgtatcaatatttttctttggaagcggtgtgtacgtgccgtcagggttatggttgaactctgagaacacaaggttccatacttccaggtaacggtcgttttccccgcctgggtaaagctccggatcttctggatcattaccgtatgcttcaccgcggtcgtaaaagatttccgtattcggtccgctcggcccttcaccgatatcccagaagttcccttccagacggataattctttcttcaggaataccgatttttttcgcccaaaactcatatgcctcttcatcttcaggatgaaccgtaacagagagaagctctttgtcgaagccaatccacttgtcgctcgttaaaaactcccaagcccatgtaatggcttcttctttgaaataatcgccgatggaaaagtttccgagcatttcaaagaaagtgtgatggcgcgcagttttacctacattttctatatcgtttgttctgatcgctttttgagcgtttacgattcttggattttccggcacgacacggccgtcaaaatattttttcagcgtcgcaacaccgctgttgatccaaagcagtgaaggatcctcatgaggcactaatgacgcgcttggctctaccgcatgtcctttttctttaaagaaatccaaaaacatttgacgcacttccgcagaagttaagtgtttcattgtatttcctcctctataaaaatcgaaattctcttcagtgacagcaaaaaagccctccccctatgcaaaccaacgtttacacagggacgagagctgtctcgcggtaccaccctgattacgggcattcatgcgcccgtcacctttaaccctgtaacgcaggataagcggcagtgattaactgcactcaggattagcttcctccgatcttctgataaagctcctttcagcttatggagcttctctctttaacagggcttcggcgtactcagatccgtcactcgagattcgtatgtattctacgagaaattatagacaagcggcacgccgatgtcaatgctccgtcctcatccgcaaaaaatggatcatcattacttttaaaacagccgtcgcaggaacagccagaatcatcccgacgatacccgcaagctcccctccggcaaggagtgcaagcatgataacgaccggatgcattttaaggcttctgccgacaatgaacggactgaggatatttccttccataaactgcagaataaacaccgtaatcaccacaacaagaaccgccttgactgagatcgtcatcgcaattaacaacgcaggaacagctccgatgaaagggccaaaatacgggatgacattcgttaccccagagataaggccaagtatcagcggatacggaagcccaaatacccagaacgaaatgcctgcaatcacgccaagaatcaagcagaccaaaagctggccgcggatataatcgccaagcgaatcatccacatcccgcaaaaaggcgctgccccgctttctccacgacttcggagtcaagtaccatactgtctttttcattaactcaatgtccttcaccatataaaacacgagaaaagggattgttgcagcaattaagaagtaatcaagcacattgcggatcccgctgatcgcaccctcgatcgttcccgcaaaaaacgcctccgtctggcggatcattttatctatacggtgatgcataccatcaggccagtcatccgtatggttatgcacatgaagaagaagcccgttatacgtttcggcaaacatgggtatattttctgacaaatccgtcagctgcacgattaaaacaggcacccctttatacaacgcccagccaatcccgccaaaaaaaagaacataaatgaccaagatgctcaaagtcctaggcaatcctttgccatgcagccattctgtgaccggaagcaataaataagatataaaaatagaaatgatcaagggaataaagatcgtttttatgacgagccaaaagggtgaccataacatatcaagcataaaaaagacatagactgttaacagaaccagcaaacaaatagccacccacaacaaaagctgcaccggtttttggagcatctgctttcacctcacctatatcttttgaggtttacaaggaattattctttatgtttctttagtcagtcagaagtcatggacattttttcacttttaattttcagaaaagtttgatcatttactttttggtcaaattttctgataggaggattgcgatgatcacatttcaaaatgtaaacaagcattacggagattttcacgtgttaaaacaaattaatcttcaaatcgaaaaaggtgaagtcgttgttatcatcggcccatccggttccggtaaaagcacattgctcagatgcatcaacagacttgagtcgatcaatgagggagtgcttacagtaaacggcaccgccattaacgacagaaaaactgatatcaatcaagtgcggcaaaatatcgggatggtgtttcagcactttcatttatatccgcataaaacagtgctgcagaacatcatgctggctccggtaaaagtgcttagacaatcacctgaacaagcaaaggaaacggcgcggtactatcttgaaaaagtcggcatcccagacaaggctgacgcctatccttcccagctttccggcgggcagcagcagcgtgttgccatcgcaagaggactggcgatgaagccggaggtcatgctgtttgacgagccgacatcagcacttgatcctgaaatgatcggtgaggtgctagatgtcatgaaaacactcgccaaagaaggcatgacaatggttgtcgtgacacacgaaatggggtttgccaaagaagttgccgaccggattgtcttcattgacgaaggaaaaattttagaagaagcagtgccggctgaattttacgcgaacccgaaggaagaacgggcccgcttattcttaagccgtattttaaatcattaaaacagaaatggggagcttgtatgaaaaagattttttctttagcattgatttctttattcgctgtcatcttgcttgccgcttgcggcagcaagggatcaaacggagaagcctcaaaggagagcaaaaaagatacgctagccgccattaaagacaatgacaaaattgtcttcggcgtaaaaacggacactcgactgttcggtcttaaaaatccaagctcaggtgagattgagggttttgatattgatattgctaaacaaatcgctaaagacattttaggtgatgagaaaaaagctcaatttaaagaggtcacctcaaaaacaaggattcctatgctgcaaaacggggatatcgacgccattgtcgccacaatgacgatcactgaagaacgaaaaaaggaagttgacttttctgatgtctatttcgaggccgggcaatcgcttctcgtgaaaaaaggcagcaaaatcaagagtgtcgagaatcttggcaaaggctcaaaagttcttgcagtaaaaggctccacctcctctcaaaacattcgtgaaaaggcgcctgaagcatctgttttagaatttgaaaactacgcagaagcctttacagcccttaaatcggggcaaggcgatgccctcaccacagataatgcgattttatatggaatggctgatgaaaataaaaattatcaattaacaggaaagccttttacagatgagccttacgggatcgccgtgaaaaaagggcaatctgctctcgcgaaagaaatcaacgcttcacttaaaaagatgaagtcggatggcagatacgatgaaatttataaaaaatggatcaaagaagacccagctgaataacaaccatcccgggatgagcaggcgatgctcatcccaatttgataaggagtgaataggcagatgaatgtgtcaattcttttcgataacttcagcatgtatatggacggtttttaccataccttgctcgcaagtgttatcgcgctggccggcagttttgtcctcggcgttgctgtagcggttatgagaataacagtctttaagccgctgcaatggctcgggaccgcatatgtagaattcatccgcaacatccctcttcttttaattacctttgttttctatttcggacttccaaacgcaggcctgaggcttgacggttttcaagcgggaacggttgctctcaccatttatacctctgcgtttatcgctgaagccatcagagcaggcatccagtctgtttcaaaagggcagatggaagcggcacgctcgtcaggctttacctacagccaagccatgctccatatcattttgccgcaggcaatcaaaatcgtcattccgcctttaggcaatcaatttttaaacttagtcaaaaactcttcgattcttggggttgtggccggattggatcttatgtaccaagccgatttagtttcgtcgagcacactcgttgtatttgatgtttatatttttgtggcgcttttttacttagtgctgacgattccgcttagcatcggtgttaactatctggaaaaacggctggaaaaaagctattgataaggagtgagttacattggatttcatcggtgcttattcacaggagcatttagcgtttttatgggatggctttctcgtcaccttgtacgttgctttcatctccatcattctgagctttttcttcggtttaatcgcaggcaccctgcgttatgcgaaagttcccgttctttctcaattgattgcagttctcgttgaaacgatcagaaacctccccttgctgttaattattttctttacgttttttgcccttccggaaattgggattaagcttgaaattacagctgctgcaattacagcactaacgatttttgaatccgctatgctatctgaaattatccgaagcggactgaaatcaattgacaaaggacaaattgaagcggcgcgctcctccgggctgagctatacacagaccctgttctttatcgttatgccgcaagcgcttcgccgcatggttccgcccatcgtaagccagtttatttctttattaaaagatacatcgctcgctgttgtgatcgccctgcctgaactgattcacaacgcgcaaattattaacggccaaagcgctgacggcagttattttttcccgatctttttacttgcggcccttatgtatttcgcagtcaactacagcctttcactcgcagcaagacgcctcgaggtccggcaaacatagaaaaggatactctttggagagtatcctttttgcattaaaacattttcgtaattcttcttctcatccgcttcatgcttcgattattcagcatgtcagattgagtcgccattcggtacacgagagctccggctcccattgccaaaagagaagtcatcgtccgattcatcctgcgcatctcctttcatgattaaaaattgatgctgcgttcatcctcagaaaacaaatcatccaagctgcttaacgttccgtcttcttccacctgatgagttgcaatcttccctttcgccactgtcagttcaataaaacagccccagcaataatattggttcacgccgattttgccgatatccttacttttgcaattcgggcatataagcatacctcacacctctatccgttcagaacgatctcgtctttccgcacctcgacaagcgaatccgctctttggatctggcgcttgcttcccgcaaggtcagaaaagaaaccgtccgagagttcatatgctacgattatgcccctgtccaaacaaaagtatacatcttccagcatccccaatatatcgccctcttgcgatttcacaagcttcatcttcatctgctcgtatgtgaagcatgatttcggaagaggcaaaagctgttctgaactgaccgaagccaatatgcggtcatcaagaatggaagagatatcacacgcccgtaatagcgcatgatgatgatgcaaaaagcgtttttgtgcaagaataaacccaagacaatctcctttcagagaaaaacaaatatcggaaattgccccgagataacaagaagttcgttctgagtatactgggaatccttctacttcatggcatgttctcaaagtgtgatcaaccaccttttgttgaacaggcttaggttttgctttgcgccttagactcatacgatgaaatcaattccactgcaaatgaaaaaaactcccgcttgcacgggagcattttattgctgttcttctttcataaaatcgaatggtgtaatgccttccatgccaatgttggcgtcgtgtacgctgaacgggagctctttttggagagcctcaagctcggcatccatttcctcaacctgtacggacagcctgttttttaaggaggtctgtctgacagttgcatcattatttttcacgccccactccagcgcctcctcttccccgcataaaatgagaaatttcttcgctcttgtaatcgcggtataaagaaggtttcttctgagcattctataatagcctttcacaacaggcaaaaccacaatcggaaattcacttccctgcgatttatgaatagaacagcaatacgcatgggtaaattgattaaaatcttttttcgtaaatgtcatttcattgccgtcaaaagaaacgacggccatgtcttctttttctgtattttcctttgcataaaatatcgacgtgatttcgccaatatctccgttgaacacattgttttccggctgattgacaagctgcaaaattttatctccggttctgtagacaacatccccgaacttcaattctctccgtttttctttaggaggatttaaaatgtcctgcagcatcacattcaattcattaatgccggcttttcctctgtacatcggagcgaggacctgaatgtcctttgctgtatagccttttttcaatgcattggcgacaaccttctcaactacttctttgatttgcgacccgccgcagcgaataaaggaacggtcctttgtcggggcagtcaaattgttcggcagcaatccatttttcatctggtgggcaagctcgacgattgatgacccttctgcctggcgatagatgtctgtcagtctcacagtcggaatcacctgggatgccagcaggtctctgagcacttgtcccggaccgacggaaggcagctggtcttcgtctccgacaatgatgatttgtatatgatcagggatcgccttgaacaaatgattcgccagccatatatcaagcatactggcttcatcgataattaacagcttcccttcgatcggctgatcctctgtatgagtaaagccttcagcaccgttccagccaagcagcctgtgtatcgtaactgcaggaagtcccgttgattcactcatccgttttgctgctctccctgtcggagcggccaaaacaatcggaaaagcttcatcctttttataagctgacggatctagtgacacaccgtgaagctctccgtagagctcgacaatccctctgattaccgtcgttttccctgttcccggaccgcctgttaaaagaagcatcggcgaggaaagggctttttgaatcgcttccttctggctgggggcatactgaacgttcatccgttcttccagttctcccaacgcgagcaaaaactctgattcgggaaactggttctcatattcggtttggctagcgatatgtttcacacgctttgcaacgttttgttctgcgtaaaacagcgaaggaaaataacagcggccatcttctatgacaatgtctttattttctccaagggcaataatcgcgttagcggcatccatttctgtgatgcgctgcccttcccttgctgactggtttaacagagattgggtgtcaatgatcagctgttccgtttctatgtacgtgtgcccctctgacagacaagtcgtttcaagcgtgtacaaaatagcagcttttacccgctcaggatggttacccgaaagacccattctgctgcccagctcatccgctttcccaaacccgatgccttctacatccttcacaagctgataaggattttcctgaatcttttcaagcgtctcagattcataggcttgatagattttcatagacagctgcgggccaaaaccaaactgattcaaggaaatcatgatttgctccagtccctgatgccgctgcaatgcgccagccagcgtgtcggctttcttttttgagagtctgggaacatcataaagcactgaagcgtcagccaatattttattaatggcgctgtcgcccagctttttcacaatttcttcagctgtttttttgccgatcccctcgaataaatcactcgataaatattgaatgatgccttccttagtcgttggaatctcctttttgaaatgctccgcctgaaattggagcccgaattttggatgagttacgatctttccgtaaaacgtgtaggtctcttcttcttgaagcgcagggaagtagcccgtcacggatacggctttatcttcaatggcttcggaggtctctgtgactttcactttcagaaccgtatataaattggtgtcattatgatagatgactgtgttgactgtcccttttaaatagggctcttcctccagtttaagctgatccggatgctgctgcacgagctgtccctcctcctgtgcctgttatgatggatcaatcagttttttagcatgaagcgcaagcatatgatctggctggatatcgattgccttgtccagcatttccagcgctttttctcggttttctttataagcataagcgacaccggcattataaaatgcatctgcatgccccgggtcttgctctgtcacagctgagaattggctgagcgcttcgtccagcatgccctcgttggctaagcacatcccgaattgaaagcgcgcttccgtatcgttttcattcagttcgactgctctttgtaaatatggcagtgcaagcttaggctgttcgagcttgacaagcaccgttccgagcatgtaaaacaggtcgccgttttccatccccgcacgaagcgctttttcaaacatgtctttggcttctttgtacatttcttttacaacatagacatttcctgctccataataagcagtggctgcgctactgtctaattcaagcgctttatcataaaacgcaagcgcacgttccagctcgtttacggatgaaagaaggttggcaaaattgatatacggaatcgcgtcttctttattttcttcaatcgcttttgtaaatgcctctgccgctttctcgtaatcgccttcctgcatcgcctctataccgagttgattataatccaccgatcatcttcctttcattaaaaaaccccaactcagtgttgaggtttttcatcttttatacgtaccacaattttgttccgtctttgtacacatcatcaattgtcccgccgccaaggcattcttcgccgtcatagaagacaacggcttgtcccggcgttacagcgcggacttgttcatcaaagatgacttccgcttcaccctcgccagtcatgcgcaccgttactttatgatcttcttggcggtaacggaatttagccgtgcaggaaatctcttcgcccttcatgatatccgaacgtacccagctgatatttgttgctgtgattttgtcagaatataaaagcgggttatggaacccttgatccacgtagaggatgttcttttcaagatctttgcctaccgcaaaccacggctcgccgcttccgccgatgccaaggccgtgacgctgtccgatcgtatagtacatcaacccgtcgtggcggccttttacttcgccgtccatcgtcatcatatcgcccggctgtgcagggagatattggctgagaaacgttttgaagttgcgttcgccgataaagcagatgcctgtactgtcttttttcgtcgccgttgcaagttctgcttctttggcgatttcacgcacacggcttttttgaagttcgccgatcgggaacatgactttgctcagcgtatcttctgtcagctgattcaggaagtacgtttgatccttgttttcatcaatgccgcgcagcattctgacttttccgccgcttctgtctactcttgcatagtggccagtcgctaaatagtcggcgccaagtgacaatgcatgctccaaaaaggctttgaatttaatttctttgttgcacaatacatccgggtttggtgttctgcctgctttatattcatcaaggaagtattgaaataccttctcataatattgcttttcaaagtttacggcataatacggaattccgatttggttgcagacgcggatcacatcttcataatcctctgtcgccgtgcaaaaaccgttttcgtccgtatcatcccagtttttcataaagattccgattacatcatagccctgttcttttaacagcagggccgccacagatgagtctactccgccggacatgccgacaacgactcttgtatcctccggccgtttttccatttcattcactccaattactacgccgccttattgtgtcagccgtttgacaacgtcggccacatgtttggcagcagttttcacttgctcagccgtattgccgaggccgaagctgattcgaatagaggacgtcagccggtcactctcttcgccgaacatagcagtcagaacatgtgacggcaggactgaaccggccgtgcacgctgaaccgctggagacagcgacaccagccatatcaagattaaccagcagcgcttccactgacacaccggggaaataaagattcagaacatgcggcagactatgctctttgtccccgttgacctcgaatgccacacctgcatctctaagcgtgtcggcaaagattgctttaaacgattgatacttctcgtttttttcgtcacgttcttcacttgacagcttgatcgcttctttcagcccgacaatgcctggaacattttccgttccggcacggcgttttctttcttgctctcctccgaataaaagcggtgaaagcttcacatctttactagcatataaaaagcctgtcccttttggcccgttgagcttgtgcccggaaacagacagaaggtcaatatggctgtttttcacatcaattggcagcaacccgaatgcctgaacagcatcggtatgaaaataagctttgtgttcctttaacagctcaccgatttcttcgatcggctgcactgttccaacttcattatttccatacatcactgtcacaaggattgtatcatcacgcagtgcttctttcacctgttttgcactgactcttccattttggtcaacgtccagatacgttatgtcaaatccgtcttcctcaagtttttcacatgtgtgaagcacggcgtgatgctcaatttttgttgtgatgatatgtctgccaagatcttttcttgcaagtgcggttcccatgatcgccaagttatcagcttccgttcccccgcttgtaaaaatgatctcctgctctgccgctccgatttctgctgcgatctgcgctcttgcttcatccacccattttcgagattctctgccaaatgaatgaatactggagggattaccgaaactgccggagaagtgcggtatcattttttccagcacgcgctcatccatcggagacgttgcggcatgatctaaataaatccgttccattatgtttacacctctgatctaaatatagaacatataagcttcttgctctccgtctgtatagctggcaagatcctctaatgttgtactgtctaaaacctcttttacagcatcccggatgcgaatccagagctcacgcttggcaggctcctcatcttccagcacttcaacagggctgatcggcccctcaagcacacggataatatctcccgcagtaatggcatccggctcactgcctaatacatatccgccatatgcgcctctgatgcttttcactaaaccggcatttctgagcggcgataccagctgctccaaataatgctcggacaaattattcgtctgtgcgatgctttttaatgaagtcgggccttcaccgtgcttttttgcaagctcgatcataatggtgagcccgtatcttcccttagttgatattttcaacatgaacacctctgttatttcatgattttccacatttataatggtaatttctatatgtttcgtccgtttattatcttatagaccaactgttattataacataccttcagcgaattttcattgaggcagaaggaaaggggcctttacccttttctaatgtacggttttccgttaccctgtaattaagtaaggagagatgatagatgaagccattggcatatcggatgcgtccgacaaaaatagaggatattatcggccagcagcatctggtggctgaagataaaattattggcagaatggtccaggcaaaacatttgtcatccatgattttgtacgggccgcccggaattggaaaaacatcaatcgcaacagcaatcgccggttcaacaagtattgcttttcgaaagctgaatgctgtcattaacaataaaaaagatatggaaatcgtagctcaggaagccaagatgtccggccaagtgattttgattctggatgaagtccacaggctggataaaggaaaacaggattttctattaccctatttagaaaacggaatgatcattttgatcggagcaacgacggctaacccgtatcatgccattaatccggcgatcagaagccggacccagatttttgagcttgaaccgttaacacctgatctgattaaacaggcactggaacgtgcgctccatgatgagcatcggggccttggcacctattctgtatccattgatgatcaggcgatggagcattttgcccacggatgcggaggagatgtccgctccgctttaaatgcgcttgagcttgccgtgttgtcaacgaaggagtcagcagacggtgaaattcacattacattagaaaccgcggaagaatgcttgcagaaaaaaagcttttctcacgataaagatggtgacgcgcattatgatgtactgtccgcttttcaaaaatcgatccgcggctctgatgccaacgctgctcttcactatttggctagattaattgaagccggtgatctggagagcatcgcaagacgattgcttgttatcgcctatgaagatatcggtttagcaagcccgcaagccggtcctagagtgctgaacgctattcagaccgctgagcgagtcgggtttcctgaagcgcgaatcccactggccaacgcagttattgagctttgcctctcaccgaaatcaaactctgccattctggcaatcgatgaggccctggcagatatcagagccggaaaaattggggatgtcccgaagcatttaaaagacgcgcattataaaggagctcaggaattaggaagaggaatcgactataaatacccgcacaattacgacaacggttgggtcgaacaacaatacctccctgatcctctgaaaaataagcaatactataagccgaaacagacaggaaaattcgaatccgccttaaagcaggtgtacgataaattaatgaaaagaaaataaaacaaaaacagccttgatcatcaaggctgtttttatgcattatttatccttcacacgtttgatttcaatgtctttcaaaagatccatgacaacatgtccgcccataatcaaacctgcaactgacggcacaaaagcattagaggaaggcggcatttttgctttacggattttcgcttcgtcattccccacttcttttctgacatcttcccgaatgacaatcgggctttcatcagagaaaatcacttgaacgccttttttgataccctccttgcgtaatttcgtacggacgaccttcgcaattggatcagtgtgcgtttttgagatatcagcgatttggaagcgtgtcggatccgttttatttgcagcacccatgctggagatgagcggaatatcccgtttcagacattccttcattaaatgaattttataacaaatggtgtctgacgcatcaatgacatagtcaagatcatagtcaaaaaactgctcatacgtttcctccgtatagaacatttttaacgagattacttcacactccgggttaatgtctgcgatccgcgccttcattaaatcaactttcggctgtccgacagttgaaagcagcgcgtgaagctgacggtttacatttgtaatgtcgacatcatctttgtcgacaagcagaatgcggccgacgcctgaccgcgcgagagcttccgccgcgaacgacccgactcctccgactccaagcacagcaactgtgctgtttttcagcgtttcaaggccttcttttccgatagctaattcattgcgtgaaaactggtgtaacaagaacctcactccacattcgtattctggtttcatctataaaatggctgatccatgagcagccgtttttctgcgcacaaaaaataaagtcccaatagtgccgttgcagctttcctttgttttgaacccgctctcagcaggtgggtgccctcttttaaatcttgtaagtcctctttaccgaatgaaaagaggcatgtacgccatttaaaaatgcgggctcccaaatcaaaaaaatgttcggtcaaaactaggtgtacaactaacacatcaggactttatttaacttgtcaaaatcatatcacagacgattttgattttcaagaatccaactgcacattcagttcttaacttttttcttgatagaaagatgaagctcgtcaagctgagcgtcacttacttctccaggcgcctctgtcatcaggcagcttgcacttgccgttttcgggaatgcaatcgtatctctcaggttcgtacgtcctgcgagaagcataacgagacggtctaagccaagtgcgattccgccgtgcggaggagcgccgtattcaaatgcttccagcaggaatccgaactgttcagccgcttcttctggtgagaagccgagaagcgcaaacattttttcctgaatatccttttcaaaaatacggattgaaccgccgccaagctcatagccgtttaagacgaggtcataagcttgtgctttcatgtcttcaggcgctgtttcaatcagctcaaggtcttctcggacaggcattgtgaacggatggtgtgctgcgtaaaaacggccttcttccggatcatgctctaataacggccagtcgatgacccataagaaattaaacaatttttcgtcaatcagcccgcgctctttcccaagctttaagcgcagggcgccgagtgatgcggccacaacttcgaattgatccgctccgaacagcagcaaatcaccttcagcagcatcaagtgcttcaatcagcttagactgcttttcttcatcaaagaatttagcgatcgggcctttcactccgtctgcctcaaccttcacccaggcaagcccttttgccccgtagtttgcagcaaaagcgccaagagcgtcgatgtcttttctggagtaatcgccggcaccgccttttacgttgatggctttaaccacgccgccgtttgctacagctgatgagaacactttaaattccgtatcctttacaatgtcagacacatccgtcaaaagcatgtcaaaacgcgtatccggtttatcagaaccgtacttgttcattgcttcgtcatacgtcattcgaggaagaggaagcttaagttcctcaccttttgtttcacgcataacctttgccatcatctcctcagccaatgacataatgtcttcctggctcataaaggacatttcaatatcaatttgcgtaaactcaggctgacggtccgcacgcaagtcttcatcgcggaaacagcgggcaatttgataatatcgttcaatgcctgataccatcagaagctgtttaaatagctgcggggactgcggcagcgcatagaactcaccttcgtgcacacggctcggcaccaagtagtcacgtgcgccttcaggcgtgcttcctgttaaaatcggcgtttcaatatcaagaaacccattttcatctaaaaagctgcgaacagctttcgtcacgttatggcgcagctgcatcgtctggaacatagccggtctgcgcaaatctaagtaacggtgttttaaacgaacgtcctctgacacttcttcagcttgatcagaaatcgcaaatggaggtgtctttgcagcatttaatacgttcactccatcagcatgtatttcgatcgcgcctgttttcaaattcggattaactgttccctcttcacgcgccaccacttttccttgaatatcaagcacgtattcatttctgatgccttccgcgatagcaagcgcttcttttgacacatcagggttaaaaacgacttgaacaatgcccgtacggtcacgcaagtcaataaaaatcaatccgccgaggtctcgtcttttttggacccagcctttcagcgttacagattcgccaattgctttttcagttatatcaccgcaataatatgttcttccaaacaatgcgtttcactccttatcccttttggtttgccttcatcacatgtataaattcatcaagtgccacttcaatctgttcgcccgtctgtgcatcctttacattgattttgttttgggcaagctcatcttcacccaaaatcgcaataaatctggcctttaagcgatcagctgttttaaactggcctttcattttcttattttcataatcgatttcactggaaatgcctgcttctctcagtttgtacaccaatgaaacagaataatcctttgctttttcgccgagtgtgacgatatagcagtcgattcccttatcaacaggcagctctcttttttcagcatcaattgcggcaagcaagcgttcgatgctcatcgcaaatccgatgcccggtgcttcaggtccgccgatctgttcgacaagcccgtcgtagcgtccgccgccggcaagtgtcgtaatcgcgccaaagccctccgcattgctcataatttcaaatgcggtgtggttgtaataatccagccctctcacaaggttcggatcgatttcatacgaaatgccaagatcatttaagtattgtttcactttttcaaaataagcggctgattcttcatttaaatatgtcaaaatcgaaggtgccgatttcatcagctcatgatcacggtcttttttgcagtccaaaattctaagcgggttcgtgtgcagccgggactggcagtctgaacaaaattcttcgatgcgaggctcgaagtgtttcacgagcgcttctctgtagcttttgcggctatcttgatcgccgagactgtttatgacaagcttaacgttttctaaacctgctttttcataaatactcatcgcaagcgccattacttcagcgtcgattgcagggtctttcgaaccaatcgcttcaattccaaactgataaaactggcggtaacggcccgtctgaggacgttcataacggaacatcggcccgacataataaagctttgtcggctgtacaggatttgcgaacagcttgttttcattaaaagcgcgaaccgcagcagctgttccctccggacgaagcgtcaggcttctgcctttgcggtcctcgaaggtatacatttctttttgtacgatatccgttgattctccgacgcctctggcaaacagttctgtatgctcaaaaatcggtgtgcggatttctttatattgataagtgcggcaagtgtctctcataatttgttcaacaaactgccagcgatctgattctccaggcagaatatcctgtgttcctctcggaatgttatatcccataggtagacctccttatgtattccttataaaatatccaatgatcgttaatgatgaaaatgaaaaaaactcccgcccctactatacatgatagtagggacgagagttatacccgtggtgccaccctagttggaatacgttcatattcccgctcgatcctttaacgcaggttcacgttcactgcctaatggcgttattcacgcgttcagcaggaaacctccggagtgttgtttcgagaaagacgcaatgggatccgctttcagcctggggcgggttcctctctaatcatgcaatctgacctactcttctccattattggttcaaatctttcatcatttgctatgtactcaatttctattataataatgggattggggttctctgtcaagctttattccggttgtttttcctcagcgctgcttctttggacataagaccaaattcagatgctgtttccgtaagataaccagtcgtatcgggatctgcgtgatcgctgtaatgcagattcgcttcaccgtcgtgaaatgcacgtcccatttttggatgatatttcatgatttgcacacctttttgattgtatttacgcttagtataaacaaatcattttatttttatttaaaaatcagaaaggactttacgatattaaacaagaatgcttttttaatgatcatcagaaaggaggacacaatgaacaagaaatactttgtccttattgtatgtattattttcacctcagcgctattcccgaccttttcatccgttacagctgctcaaggagaagcggtcatcgcaacagatgaaatgaacgtcagaagcggcccagggcttagctacggcattacagcggaagtaaaaaagggagaacgctatccaattttaaaggaagatggagactgggtgcagatacagcttggttctggagaaaagggctgggtagtctcctggcttattacaaaggaagaccaggccagcacaagctcctcaggaagcagtgacactgtgacatcaacagaccccgatctgcggatgagaagcggcccgggcacttcctacgaagtcatcggcaaattcccgcaaggcagccaagcatctgtcattgataaagattcgggctggatcaagatatcctatcacagtgccaccggatgggtatcatctgaatatgtcacatcaggaggcagcagttcagcgtctgatgagagtgaccaaaccgaggattccggtgcgtcaacgacgggcacagtcggtgtttcttcgctaaatgtaagagcctccgcctcacatgacgcggcaattataacaaaacttgatcgcggaacgaaactgacggttctcaacgagaaaaatggctgggctcacattgaggtgaacgggctaaaaggctgggttgcaagccattaccttttgactagttctgttccagctgatgattcagcaaatgccggcagttcatcctccgctaaaaaagcctatatcatgtacggaggaacgaatctaagaagtgatgcgtcaacatcagcttcgatcgttgagcgcgctgccaaaggagattcatacaccattaccggttcaaagggaagctggtatgaaataaagcttgataacgggcagactgcttatgtagccaattgggtggtccaaacgtctaaaagcgcagaagaagcaggtgaaccgccagtctctgattccccgtctggaaacggctctctaaacaataaaacgattattgttgacccgggacatggaggaaaagacagcggaacgatcgggtattcggggaaattcgagaaaaacctgacgatcaaaacggcaaaactgctcgccagcaaacttagatcggctggagcggatgtatatgtgacacgccaggatgatacctttgtcagcctgcagtcacgggtctctacctctcactaccgtaacgctgacgcctttatcagcattcattatgacagctatgcggatacctctacaagaggcagtacagcatattactacagtcctgccaaagatcaggaactcgcatcagatgtccactcagaagtggtgaagcgttcttccattccagaccgcggcgtattattcggagattattatgtgctccgggaaaacagacagcccgctatgctgtacgagctgggatatgtaagccatccgcaggaagaagccattgtacatagcaattcataccaagaaaaagtaacagatgggatcgaaagcggattagagaaatacttccaataaaaaaagctgccttttggcagctttttttattttgaatccataatgagcgtgaccggtccggagtttgtaagctgaacatccatcattgctccaaacgttccggtctccactttgattcctttttcacgaagcaggtcattccatttttcataaagacctaaagctttatcaggtttggccgcgttcatgtagttcggccggcgcccttttttcgtatctccataaagcgtaaactgtgagacggataaaatctctcctcctatatctacaagagacagattcattttcccttcactgtcatcgaaaatacggagattgacaactttatcggctaaataagctgcatcatcttctgtatcatcgtgagtgatgccgaccagcaccataaggccttgtccaatttggccgacgacctcttcgtccactgtaacgcttgcttctgttactcgctgaacaactaatctcattttctaacccctttagttcatgacgcggcgcacagagtagatatctctaatctgtttaatacgctcgacgactttgtgcaagtgattgatattctgtatgaaaatcgccatatggatggttgccactttattgcgatccgatttgccagagacagatgaaatattggttttcgtttcattcactgcctggagcacctcgttcagcaatccgcggcggtcatacccaagaatctctatctcaacattgtattccttgcgcttttgaacttgtgactcatgctcccactctaccgggatcagccgctcttgggcttcattcgttttgacattcggacagtcttcgcgatggaccgaaacccctctgccttttgtgataaagccgacaatatcatcacctggcacaggattgcagcattttgataaacggacaaggaggttgtcaatgcccttgacacgaacgccagcttcccgttttcttccttgcgggtatggcttaggttccccagtgacttcctgaacgatcttttcctgttcttcctgatcgcgctgctttctctctttttctgttaggcggttcgccacctgcagagctgtgatgccgttgtaaccgaccgccgcgtacatatcctcttcatttgagaaattaaatttgtcagcaaccttttgaatattctccggcgttaaaacatccttcaattcaaaatccaagtttttaatttctttttcgaccagctcacggcctttttcgacattttcttcacgccgctgtttcttaaagaattgacggattttatgcttcgcttgggatgtttgggcaagcttcacccaatcctggctcgggccgtaggaatgcttagaggtgagaatttcaacgatatcacctgtccgaagcttatggtcaagcgtaaccatttttccgtttactttggcaccgattgttttattgccgatttcagagtgaatccggtaagaaaagtcaatcggaacagaaccggacggaagctcgattacatctccttttggcgtaaagacatacaccatgtcagagaacaaatcaattttgagcgattccataaattcttctgcatctgtcgattcattttgaaattctaaaatttcacggaaccaagaaagctttttctcaaaggttgcaccttcattggctgctttcccttctttataagcccagtgagccgcaaccccgtattccgctatttcatgcatttcaaaggtgcggatctgcacttcaagcggatcgcctttaggcccaataaccgttgtatgaagcgattgatacatattcggcttcggcattgcgatataatctttgaatctgccgggcatcggtttccagcatgtgtgaatgatgccaagcaccgcgtagcagtcctttatgctattcacaagaatacggacagccagcaaatcgtaaatttcattgaattgcttattttgcagcaccatttttcgataaatgctgtaaatatgtttcggacgtcccgagaagtcagccttgatatttacttcttcgacacgtttcttcacttcattgacaacctcatcgacataaagctcacgttctgcacgtttcttcttcatgaggttgacaattctgtaatattgctgagggttcaaataacggagcgccgtatcttccaattcccacttaatttttgaaatcccgagacgatgcgccaaaggagcaaaaatttccagcgtttcattggagattctccgctgtttttcctgaggcagatgtttcagtgtccgcatattgtgaagacgatccgccagcttgatcaatatgaccctgatatcttgagccatagcgacaaacattttgcgatgattttccgcctgctgttcctcttgagatttatatttaattttgccgagtttcgttacgccgtctacaagcattgccacttcttcggaaaatgcttctttcaggtcatcgagcgtcacatctgtatcttccacgacatcgtgcaaaaatccgcccgcgattgtggaagggtccatttcaagatcaacgagaatccccgcaacctgaatcggatgaataatatatggctcgcccgatttgcggtattgctcgcgatgagcatcttcagcgtacagatatgctttttcgacaaatgcgatatgctcatcagatagatagctgcgcgctttatctataacttgctcggcagtcaatacttgttcgttcgccatggaatcaccttttttaaaatgtaaactgtattgtagtttattatcaagaaaaaaacgaaagatgtaaagagcagaagttcaaatagccaaatattatataaaataaatgcaaaacaataggaaaaaagcaccctgacatggagtgctttttcgttatgcggttatccttagtatttcatcaatgttaagatgtcgtaatcttcgagcttatttctgccgtcaaggtaagaaagctcgattaagaaagcgataccagcaacaacgccgccaagttcttcaacaagtttgattgtcgcttcaattgtgccgcctgtcgcaagcaggtcatctgtaataagcacacgctgaccaggcttaatcgcatctttgtggatcgttaatacgtcttttccgtattccaagccataatccactttgattacttcacgaggcaacttgccttctttgcggaccggcgcaaaacctacgccaagcgcgtaagcaacgggacagccgataataaagccgcgcgcttcagggccaacgaccaaatcaatttgcttttctttcgcatattcaacaatttgatctgtggcatagcggtatacatcgcctttatccatcagtgtcgtaatatctttaaattgcacgccctctttcgggtaatccggtacaattgttacgtattgttttaaatccatctgttttatgtcctcctcgtactttcataagcctctgaatcttgtttcatcagcttattcagccattccttcagctcttcagcagaagaataattcagcttttgatccagttccatcagctgctgtttcgcctgatatgtttgtgagtctgttaagtcgcgtttctttgctccgctcacaacagacagcacaccattctctattttaacaaaaccgagatcaaaaaacacctttgtcatgaaattgattgtttcaacggaccagcctttatgttttgcaagctctgaaccgtgttttttcacgtcaaaagcgcctcttttcagcaagaacgcataataccatttaaagtggtctcttgcgggaaaagttgataaaaagtggtcctcatgattgagaaaaataaaatatatccgctcgggcgcctttccttccagcaaacgtgcgagcatgtccagcgaaggcggcggatccagtaatacaatatatgcaccatcgaggtcaaacgcctttgcttgatctttagaactgatgacgtgcacttctcggcgaaggtcttcagtttgaagtaatgttgttgagtcttctttgaaagagacaatggcccgtttagcagatggaagggcggaaactgtgtcttcccacgtccgttttccccttaaatcaaacagctgccattcagaaacagcggcatcctttatcataagctgcggcttttttcgattgttccattcgttgattgacatctcaccgacaatagaaattcttgaacccggtacgatgccttcttcaagctcgcctttattaaaaccgacgcaatcaagctgggacgactcgtttctgatcgtcattttgacatgagttttatttgcccctatcttgcggacatcttccagtactgcgttttctacgagaacgtgcggtttcgggttcagcatgccaaaaggagacagcatgttcatttctgcgatgctttcaactgtaatgtcttcgacgccgcagacaaggtcgacttcctgtacgggaataaaatcctcttccgtaagcgtattgtccgctatttcattcagcctgcttcgcaaatccggcacatcttcggctttcagcgtcatccccgcagccattggatggccgccgaaatgaggaagaatatctctgcattcagaaaggctctcaaataaattaaatcctctgatgcttcgggccgaacctttagcgattcccttttcttcatcaataccaagaacaatggccggtcggtagaaacggtccacaagctttgaagccacaatcccgacgactcccgggttccatccggctttggccacgacaattgcagtttgatcgagcccttgctgttcaaccatgtcaatcgcttcatccgtcattttgctgaccattttttggcgctctttgttcagctggtcaatttctgcggcaagctcttccgcttcaaacgaatcctctgacataagcaaatgaacagcgggatccgcctgttcgattcttccgacggcattcagccttggtgcgagctgaaatccgactgtttcttcgttcgcttctccgatgtctccgcctgacagcttaatcagctcttttaagccgagccgatttgtccgtcgaagcctttcaagtcctagtgttgctattaatctgttttcgtcatgcagcgggactagatcggcaatggtgccgatagccgccaggtcaagcagttcatcaggaagttcacccaataaagcgtgggcaagcttaaacgcgactccaaccccggcaagctctttaaacgggtaagtgcagccaggctgcttcgggtggacgatcgcacggacatccggaagctccggtcccggttcatgatgatcggtaatgatgacatccagtccgagttcctttgccaccttcgcttcatgcacagcggcaattcctgtatcaaccgtaatgatcaaagagaagccccgttctttaattgaacgaaacgcctgttcattaggtccatatccttctttaaaacggtcaggtatataaaaatcaacttgagccgacagtttttgcagcgtgtgaagcatcactgacgtacttgtaaccccatcggcgtcataatcgccatatatcataatcttttcttgttgtgaaatcgcctgttttattcgatctgccgcttctttcatgcctttcatttcaaaaggatcataaaaatcggcatcctttgtatgtaaaaacagcctagcgctttctgccgtatcaaagcctctttttacaagcagggacgcaacaagaggtgttatatgcaattgttctgtgagtgatttgaccttatcctgatctggtcgctggatttcccatcgcatttttgacgctaacataaattcacccctcaaccaccctattatactagagcaggctgaggggtttcaaataatattcgaaaactagtcttttttctcaatcatggctgatgcatcctgtgtgtcagtctgatcagcaagatgagtatcctcttgtttatgtattgctgttctattttctttccgcaaggtttttatttcccgcttcaatttcattacctgaaaaatgccgacagaaaatacgatcagtgctcccattaaaactgagcccaaaataacaagaatgagcggccattctgatcttccaaacaggtaatcaacttctacggatcgaacattaatgactgcgaaaatagcgacaattaaggtgaaaataagtgcgaaaataatggtccattgtttattcattctcttttcccccaaacttcttattgaggtaactttccccatcaagactggttttaaacatggcttaacactaggttaagctccctttgctgttaatttttcccggatcagcctcttcagtccggttccctcaccggaaatcacaagtgtatcgccttcgtcaatgactgtttcagagctcggattcagttgtttatcctgattctttttaacaattgcaatgaccgtcacatgatattcctgacccacattcaaatcaccaatcgtctgatgaatggcaggcgctcccgcctctgctttacaccactctataatcaaatcatcaagggctgactcgacctgttctaatgctttcggtttatatgccattccgccaagaattgcagacatttgccttgcttcagcgtcatcaaactgcacggaggcaacacattcctcatggtcgttttcgtcaaaatagtaaagctctctccgtccgtcatgatgaatgataattgaaattttatcacggtttctagtaatcatttcaactttttgtcctatgcccggcagctctgattcgcgaaccctcatatataaaccctcctacatatctgaaaaccagccataaacacttttaacaccatatatatgtttaaatgtaagcgtatgtcattatagcaaatgtctattttaagttcaatgaaacttcaaaaaacaggctgccctgcagaggacagcctgatattttttattgcgccgaatcttttttcagttctcttcctttccatgcaagccaaatttgtgcggcaatgtatagagaagaataaacgcctgttaacagcccgaccaataaagcaattgagaagttagtaatagaagatgctccaaagatcagcaatgtcacaacaacaatcacaacggttaatacagtgttaattgaacgtgtaaaggtttgctgcaggctcaggtttactatatggttcagatcggcaaatgttttcggcttacgctttttcatatgctcgcggaccctgtcaaatgtaacgattgtatcgttaatggaatacccgattatcgtcaagatggccgcgatgaacgtaacatctacttcaagccttgtaatactgaagaatgtgacgataaagaatgcgtcatatagcaatgaagcaatggcagcaatcgccattttgtattcgaatcggattgaaacgtaaataatgatgccaatagaagctatagcaactgcgtacagcgcatttcttgccagctccttaccgactgtcggtgaaactgtgctgacatttggctcagacccgtatttgtctttaaaatacgtttttacttttgctatggtttctttatctggcaccccgacaaaacgggcaacaccgatattgctcttttcgcctgacagaactacagtatcagggtccatacccagagattcaaaatccttctcaacttgctctgtcgtcagcttatggtcgctttgtacttcaatccgtgcaccgcttgcaaagtcaatgccaagattcagcctgaacacaagcaggataataatcccggcaaccgtgaccgcactggagaaaataaagaagtatttgcgtttgctcgtgaaatcccatttttggaatggcgtatgcggctctgtattttcatccgtatcctgaatatccatgatatgtttcttattgacaccaaaccagccttttttccgatcaagccatctgctttccacaaggagagcgaggagaaatctcgataagaaaacggcagtgataaagcttgtcaaaatcgataggatcagcattgtcgcaaaccctttaacagagcttgtcccaaagataaagagcacaaccgctgcaataatggttgtaatattcgcgtcaaaaatcgtcgcaaatgaccgtctgtttcctgaacggaaggcagagcggactgactttcctagcttgagctcttctttaatccgctcataggtaataatgttggcgtcaacagccatcccgacacctaaaatgagagcggcaattcccggaagcgtgagtacggcattcatccagtcaaagatctggagtgtaatgtagatataaacagacagcgtaatcaccgcgattaatcccggcagacggtaatagaaaagcataaataagaaaataattgcgataccgacaataccggcaaacaccgtatcatggagagcctgctggccgaattgtgcgcctactgatgtcgaatatttttcagtcagtttcacaggaagtgcgcctgcatttaaaatgctggctaaatcttttgcttcttgaaccgtaaattgcccttcaattgtaacatcagttgtgtttaattcctggcttacatttggggcggatacatatttagggtgctctttttgaacctcttttttaaaggagtcccctttttcgtaatccatccaaataacaagctggttgtttggcgccattttcatgacctttttggtcacttcgccgaatttatcagcatctttcagtttaatgctgacaatcggttcatttgttttggcgtcatacgtttgtttagctccgttttcgacgaggtcagagccattcagcaattctttgtcattcgtatctctgaaagaaagctgcgcttcagtcgccaaaatttcacgcgctctgttttggtttgtcacaccagcgagctgaacgcgaatccggttattcccttcaatttggatgttcggttcgctgacaccgagaacattggcccggcggttcaatgcctctactgtgctgaccagaacgtcttttgtgattttgtcacctttttttacaggctgtacatcatacagcacctcaaatccgccttgcaaatccaatcctaacgtaatattgttagcggcaggcttcgtaaagtagcccaagcccgtgccaatcaatagaacgaaaaggaaaaacgcaatcaagcgtccttttttcattatgtatatcctcccttaaacctgtgcgaatcaacctgctatctcagcagttcttccaatgcttcctggccctcttcactgcccagccaattagacgttttaaatgactcaacggttgcatagttcataaattcgccaattttcactgataaaatatcactcgccagttcataaatgttcagttccgttttctttttccacttcttatctgttaagtatgaccacaaactttcgagttcaacatcatcatacccgagaatcttaaactcttccagtttgctgtaaagaaacggcctgacgtggtctttatatagatcggctggatgcttctccacgaattccacgctccttttttattgtttttcaagaagacttgtcatgcttggacgatatatacgcatatctttattgtatatgattccaggtagtttgagaaggcagggggtaaaaatggcgaaacagacgtttttaaagggcactcttatccttatcgcagcaggaatggttacaagaatgctcgggtttgtcaaccgggtggttatcgcccgttttatcggtgaagaaggagtcgggctttacatgatggcggcgcctaccttcttcttggccactacattaactcaattcggtctgccggtcgcgatcagcaagctagtcgctgaagccagtgcgcgcggagatcatcaaaaaacgaaaaatattttagtcatgtctctgaccatcacgggagtgctcagcctcatctttacaccgctgtttctgtttttcgccccggttatggctgaaacgatgctgacagataagcgaacactgtatccgctcttggccattacgccggttgtgccgattattgctatatcgagtgtgctgaggggatactttcaaggaaaacagaatatgaacccgcttgctatgtcacaagtccttgaacaggttgtccgcatttcactcgtggctgtctgcacaacgatttttctcccttacggaattgaatatgctgcagcgggggcaatgctatcctcagtggcaggggagctggcatcacttctttatttattcgtttgctttaagtataaaaagacaattaaaatcagaaagcattttttccagtcaattaaaaacggaaaacaaacctttacccaattaatgagcgtgtcccttccaacaaccgggagccgctttatcggaaacctctcttggtttttcgagccaatcgtcgtcgctcaaagccttgccatcgccggtgtggcaacagttgccgcaacaaagcaatacggggaactgaccggctttgccatgacgttgctgactctgcctagctttattacatattctttgtcgaccgcgcttgttcctgcgatcagtgaaggaatggagcagaaaaaattgcaggtggtggaataccgcttggaacaggcgatgcgtctctgtctgctcagcggaggcatttcagttgttattttatttgtatttgcggatgagctgatgagagtgatgtacggttcttcaggcgcagctgtatttataaaagtgatggccccgttttttctgctttattattttcaaggcccgcttcaagctgttctgcaggcgcttaatttggcaggagctgcgatgatgaacagcttaatcggagcgctagtcaaaacaggccttatttttgtccttgccacaaggccttctcttggcattatgggcgcggcattagccattgtgacaggcatggtgctcgtcacgctattgcacgcagcaaccgtaagcaaagtgctgccgatcagcatcaaaatcaaggagtacgcgctcagcttcgctgttattgtaatttgcggattcatcagctccgccatcaaacattatataagctttggagcatctgaggctgtcaatctagccggatggattgcggtgagcgccgccatttatatgatcctcctgctcgttttccgtttaattaaaaaagatgagcttcgccgcattcccattatcggacgtctgatcatccgataatagtcacgtgcggtacccatctttttcgtcaataaataattctccgtctgtaaacgagcaaaatgaaatatctgaagggtttgtgtatccgtgtttttgcaaactttcaagcagccattttctatctttactgattctggacaggttttctgtttgaatgaagccgtctataatgagcggcatttcgagctgccgatgctctccgctattttctttctttacaatagtcagtttgcccgacggctctaaaatggcaaatgatacgtcagctactctgtcgacgctattttctctgagttgaaccattaaatcatcaaaattatatcgctgtgatttcatggcttcttcgtcaatttttccatatttgataattatagtcggcttaccgtcaagaagctggcggacttttcggttttttaaagaaaagtatgccaaagtcacttgaatgatcattaatacaagcattggcaaaatggtatgaaatagatgatcgtctacgttttctatggctaaaacggcaatttcagccatcatgataaagacaacgagatctaaaatactaagctctccgatctcccgtttgcccatgaaacgaaaaatgaccaatatcacaaaatacaatacgactgtgcgaaacgcaatagtgagaagctcttccatcatgcacctccaactcattataggttgcaacaaaatgatcaatttatgtaagaaaaaccgattgcatttcacaaagcttttacgtctaattcaagggataagggaatacatttttacaaagacgagccatcagcatgtctgacggctttgtgcaaaaagaacagaagccttttaatacaggcagagaggagacaatcatggaggaaacgaaacaagttggaaaaggcattctttacggcttaatcgccatattttcagccatgctcctgacaagtttggcggtttcacttttattgaccgcaacctcgctggaagaatcatcatttaactggctgatcacagctatctcatttctctctttatttatcggcgggttcatttcaggcgggaaaggcaaggaaagaggctggatgattggcgcattgaccgccttaagtttttctctgattatcttattgtttcagtatttaggattcggaaagacatttacagcagaacagctgatcttccatctgggatttttaggggtgtgcatgctgggcgggattttcggcgtgaacatgaggggaaacaggtcttccacataaaaaagagcgggctcacttgcccgctcttttttgtttgctatgtatagctcctgctgttattcagcagcagaaacttctctgatcgcgcggcggtcgaacgtaagacgtgtgttatcaccagtcttaattacgactttgctttcgtcgatagagtcaacagtaccgtgcaatcccccgattgtcactactgaatcgccttttttcagttcctcttgcatttggcgtacagccttttgctgcttttgctgaggacgaatcagcaagaagtaaaggaccgcaaacattaaaataataggaaccaatgtacctaaagtgccagtcatcattttcacccctttctgtaagcctgttatgtttatttagaagcttttcgcatttggcttgttatagccgtaacgctcaaagaactcttctctgaaatcacccagacgatcctcgcgaatagcctgtcttacctgctccattaagtgtaacagaaaatgaaggttatggtaagttgttaatcgaaggccgaatgtttcattacagcgaatcaagtgcctaatgtacgcgcgagtgtagtttttacatgtatagcaatcacactcttcatcaatcggacggaagtctctttcaaatttcgcatttttcatattgagtcgtccttcagcagtaaacactgtgccgtttcttgcaatccgtgtaggcagcacacagtcaaacatatcgaccccgcggatcgctccgtcgatcagtgcatccggagaacctactcccatcagatatctcggtttatccttcggcaagagcggtgttgtaaattcgagtacacggttcatgacatccttcggttcacctacagacaatccgcctatagcatatcccggaaaatcaagcgaaatcaagtccttcgcactttgtgtccgcagatcttcatattctccgccttgtacaataccaaacagcccttgttcatcctgacgattgtgggcattcaggcagcgttccgcccagcggcttgtccgctcaactgacctcttcatgtagtcgtactccgccgggtatggcgggcattcatcaaacgccatcataatatcagagccgagtgcgttttggatctccatcgctttttccggagataaaaacagcttgtctccatttagatgattgcggaaatggacaccctcttcctctatattacgaaacttgcttaaagaaaagacctgaaaaccgcctgaatcggttaaaattgcgcggtcccagttcataaatttatggagcccgcccgcttctttgacaatgtcttggcccggacgaagccatagatgataagtattgctcaaaatgatgcctgcatccattgctttcagctcttcaggcgacattgttttgactgtcgccagtgtgccgaccggcataaaaaccggcgtttcaaaggagccgtgaggcgtatgcactttgcccagccgcgctcctgtttgtttgcattcttttataaattcatagcgtattggttgttcagccacttttgatgaggcctcctgttctcaaattatataatcagcatcgcgtctccgaagctgaagaaacggtattcctcttccactgcatggttataggcacgcagaatgttttctcttccagcaagcgcgctgaccagcataatcaatgacgatttcggcaaatggaagtttgtaatcattccgtcaatggctttaaattcatagcccggataaataaaaatagatgtccagccgcttgatgctttaaattgcccgtcatgttccccggcaatcgtctcaagcgtgcgtgtcgaggtcgtgccgacagaaatgatccgaccgccattttctcttactttgtttaaggctgcagccgtttcttctgacatttgataaaactctgcatgcatattatgctcttccacttcatcggcactcacagggcgaaacgttccaaggcctacgtgcagtgtgatgaactcaatttgcacgcctttgtctttcagctgctgtaagatttcttccgtgaagtgaaggccagctgtaggcgcagcagcagagccgatttcttttgaatacactgtctggtagcgctctttgtcatcaagctgttctttgatatatggagggagcggcatctctccaagggattcaagcacctcgtagaaaataccgtcatattgaaattccatctttctgccgccgtgctcaagctcttccgtgcagattgccttcaatcttccgtctccaaatgtgacaacagttccttttttcacccgtttcgccggtttggcaagtgtttcccatttatcaccggtttcctgtttcaacaaaagaagttccactttcgcgccggtatcctcttttgtgccgaataaccgcgcaggcagtacccgggtattgttcaggactagacaatcgccttcgttaaagaagctgataatgtgtttaaacgagctgtcagtaagctctcctgtatgtttatcgagcaccatcagccttgaagcatcacgctgctccaacggtacttgtgcaattaaacgttctggtagttcaaaatcaaataaatcgactttcatgatgatttcacctttattctagtcttttgttatttcattctgccaaaaagattaagcaaaattgataataccacacttataataatacaagtgacaaccgggaagaaaaacgtgacatttcctttttttacaaaaatatctcccggcatcttgccgacaaaatgcaaaactgctccgataataagcaaaacagcaccaagaatcataatgatcttaggaaattcagtcatatcggggagcctccatttggaaatgatgataaacggccggtgtcacgatccttccacgcggcgttctttgtataaatccaatttgcagcagatatggttcatatacgtcttcaatcgtatgcgattcctcgccgatggtagctgaaatcgtatcaaggcctactgggccgccgttgaatttttcgatcatgcccatcagcagcttatgatcaatatgatccaaaccgaggcggtcaacctgaagccgctccagcgcattctgagaaatgtcttccgtaatcctgctgtcacccagcacttgggcgaaatcgcgcacccttctcagcaggcggttcgccacgcggggcgtccctctcgatcttcttgcaatttcaagagccgacggtttatcaatctcaacctcgaatacatcagcggttcttgtgacaatatccgccagttcttcttgtgtatagtactcaaggcgagacatgacgccgaatctgtctcttaaaggagccgtcaaaagccccaccctcgtcgtggctcccaccagcgtaaaaggcggaaggtcgaggcgaaccgagcgggcagatgggcctttgccaatcacaatgtccaggcaaaagtcttccattgcaggataaagcacctcttcgatcgatctgtgcagcctatgtatttcatcaataaataatacatctcccggttccagcgccgttaatatagcagccaaatcaccaggcctttcaatcgcaggccctgatgtcgtccgcaattccactcccatttcattagcaacaatcgaagcaagcgttgtttttccgagtccgggcggcccgtacagaagaacatgatccagcgtctcctgtctcattttcgccgcatctataaacacgcgcaaattttcttttaccttatgctgcccgatatactgtgccagattttgcggcctcaggctttgctctatcactgattcatggttgtctgcttcacttgagacgagccgttcatccatgaacatcaccttactttaatagtttttgtaatgcttttttcacatattggtctgttgtcagcccaatttcttctttaaggtgaggaagcacctttttgatttctttttcagcatatccgagaaccctgagggcttcaagtgcttcttcaagagccgtttccgctgtttgcttttcaagcctttcttcatgattaaacagattttcaatcatttcaggcacaacatctgccagctttccttttaaatctagaataatctggcgtgcggttttttttcctactccaggaaacttgaccaaaaaagcttcatcttcattttcaattgcttgaatgaccgctccgggatcacccgagcccaagatggcaagtgctcctttcgggccaattccggtcacgtttaacagctttgtaaagagcgccttctcctctcttgttgaaaaaccgtaaagcgaaaaagcatcctctctgatatgatggtatgtaaaaatcgtttcctggcttctctccttatatataaagggattcggcgtgaaaatctgatagccgatgccgccgttctctatgacaatatattggggagatacataatcaatcgtccctttaacaaattcaatcacgcaaattcacctctttgactgttcttcattgtaccataaaaacagccaaagtcttatagaaaagttaacatacgttcgcttctctctcattctttcacgaaaaaaaagacatgaattcatgtcttcaatcagcggacgttacccgctgtatgtcttcatatgttcgatgacatcctcaaactccgcttttgtccgaaatggaatgcctttcagcagatttttttgcatatggctttccagcctttctaaatcaatttgaaaaaaagactgaattggttcggaagctggctcaggccgcccatgaaaagtggaaatcactccattatccgatacaccgatatacccgttgaccttgctgagcggagaaatatcgtccatttgcttccggaagagcacatatccctttttttgttccacaagcgtccatccggcataagctgcccaaaaatcatccatagaaaacactttttcatgcttatgctcaatgctgacatcgccgtccaaatacaccttttcaagctgcacatgcacctgcagcggctcatagtgctccacttccgcgccaagtgcgcgggaaggagctcctattaaaaatactgccgctgagcaaagaatgcccagcaaaagatacgccgtgctgaatcgtttcaccctctacacctctttgcacacgtttatgattagtttgaccaaagaggctactgcttaaccgttttatcaaaatttgtctgcacattttccctgacaaaccgttcctccgtatacacatctgtgctttgctcagaaattgtcaagaatcgcgtcagaaaggcactgaaaaaatacaatgccgcaaagatccaaatcacgccgcctgcaccgagcggcccaatgaaaagactcacgatgcccggcgcgataaacgcacataaaccagatcccaaattcaacactgacatggcagcacctttattatcaggtgcaagcgtcggcaaaagcgcgcttaatgggacgtaccctgctaaagccgcgccgtagcagcaggcgataatcatgagcacccaatactgatgcccgatcagctgaggcgtgtaatacagcgccagcgtaaaaataccgcatccgacaccgccaaaccacatgaccgtattgcgccagccaagtttatctccgactgcaccgaaaatgatattaaacacaatattcacaaaaaacagcgtcccccatatttgcagccattccgaaaccgaatacccgtatcgtgctaaataagtaggaagaaagatggcaaatccaaattgtcctatcgcattaatcgtcttgaccactccgccgatgcctaccttagggttttcaaacataattgtaaatgccttcgacaattctttccatttcggctgatcttgtttttgtatcggagtaaatttatctttgttaaaaaataaggcaagaattccgcctgccgccacaaacagtaaagcgctccaaagcgtattgatttctccaaaggccggaactgcatagctggaatagaacgggcccagcacgttaaggccgcacgtaaacataaaccaaaaccagccgacggctttgccgagaatattttgagaggtgctgtatgacacccatacgagaaaagagtatgcaaacagcggatatcccaagcctctaagagcatagctgcccaagagagccggataatacatatgaggaatcgcccagccgataaaagcggccgaaccgaggataaatgcaagcaatccgacagtcatcgtttttctcggcccccaagtttggacaaacgttcctgaaagccaagctgagatggtgacagcaatgccgtacatggtaaataacgatgcggattgctgcatactgagaccatgatcaacgagaaaaggagacagccagccttgttcgaggccgtctccaaccataaagatgacaacgccaatataaccccaaaccatgtgagaaggaattccgattttgttcaaaacatttcctttagcatgtactgtattcattttctccaccgcctacttaaagtatcaatggagtatatacccaagcttgctgaattgtaatcctgttagattaaaaagcgattttttcagtgtgctcaatgctgacaggcatgccaaaagcaagcgattgctgtgctgctctggcgatccttccggcctgtaaaccgtcattgccggtgcagggagtctcctggtttgtgccgatcgcttctgcaaaacggagaatctcctcctcatatgaatccttatagcgttcaaggaaaaagaaatgcggtttatccttcatcacaaaatcagctgttgacacctcaaccgttgtcggcctgctattatcagccgctgcagagcctttcgtcccgaaaacctcaacccgctggtcatatccgtacacagcttggcggctgttatcaatcacagccatggcaccgttttcaaaagtcagtgtaataacagctgtatcaatatcacccagctccgcaaaagaaggattcaccaaagctgcccctttggcatacacttccgtcacttcgcttcccataatatatctggccatatcaaaatcatggatcgacatatccataaacaatccgcctgacgtacggacataatctatattcggggttctgggtcccgggacgtgatttttaataaatgaggtgtaccgatttcaccattttcaacaatcgttttgattttcttaaaatgaggatcaaagcggcggttaaatccgacttgaagtgttacaccgtgtttccggacagccgcaagcgcttcactcgtttcgtccagagagaaactaacgggcttctcacaaaatatatgctttttcgcctcggctgcttctttgatcatctgtgcatgtacggctgtaggagagcaaataaaaatagcatcaatatcaggatcatgtaataaatcacgataatcagaggttatgtattcaatctgatgactgtcggcccagctttttatacggcttgcctgaatgtcagagactgcttttattttcatgtgaggaatccggcttatattttgaacatgaagtttgccgatgcggcctgcaccgataatccctgtcacaatctgttttgtcatggcttcttcccccttgatcattcacgaaagcgctttatttaaaattaatactatcccatttgtaagcgcttttcaagaatggaaattaaacgttctatgtctcttttatcacaattcatgcttataagtagccttcttcttcaagaccagatacactagaattaggctctttttcctgaacagtttatgattttcctataaacagctgcataaaatagagcaaagaaggtgaatgaaatgctgacaaaagcagaggcactggcccataccgtcatataccgcaagaacagcagatttgataaagtcaaagagaaatccgaggaattaacactaatcggcaagggaagaagcgcctatgtgtttgccttaacagaaggcggtcgaaaaatggcgctgaaagtattttttccggaatatcaagcgacagcagtcaaagaagcagcgatctatgaaaaattagccgggtccgcattctatcctgacatttacgaaactggcgattcatttattctcatggaatatattaaaggtgaaaccttttataactgtctgaagaaaggcattgcaatcagtgatgacatgattcagcaggttgaagaagcgctttctgacgcccgggcagccggactgaacccgtcagatattcatttgcggaatctgatattgacagaaaccggggcggtgcgggtgattgatgttgcgagatttgagcagacaaaaacatgcacgcagtgggacgacttaaaatccgcatatcatgcactctacaaaaaaccgatattccccaaaaagattccgggtttttggctggagatcatcgcatttttatataagaaagattggtttcaaaagcatttcgcacagcggaaaagaaaatattcttaaatcaaaaaggcagccgcacaagcggctgcctttatcatgtattttttactttctgacggcagaaatcagtttcatttgttcaggcgacagcttaattcgatagcctctcacagttaagtagaccgcttctgggtccttctcaccggaatgacaatacgttttttccatttctgtctcccctcaccctttattggctttatttcatcttatcattgctttattaaggtagttttaaagaaatgtaaagatcatatgaatccgatatatagtaaaatgagagaaaaaaagggagagagtcacattaagacacgcagcaacatcccgcttattatgtttgccctgctggtcttcttcggcggcgccatctattggatgttattttcactaaaaaacgttccgaaaggcaatctcgtccaatcggttgattcgccggacggcagctatacgttaaacacttatgtatccgaaaacatcttgagcttagatgcagccagaggtgaacttgtaaatgaaaaaacacttgtcaagagaacaatctactggaattacccggacagccgcccagcagtgacgtggatcaatcacaatacagtgaaaatcggcaatcagactttacatcttgatactgatgaaacgtatgattggcgaaaagatgatcattggatccgtgaaaaaccgccgcaggcgtcagtgaggtgatgaaacatgaataagatgaacggaacaaatgatgacaagcatttcaatcattttgtgattgctttatcctttatatacggtttgactgaactaggctatttgttgctgaaggattttataacaattgccataagtttgcctctgtagaaaaacgcagcgtagtcgatacgccgcgttttttctttttcccttcctcttcttattgttaattacaggtcatataatgtgacaaatcgattgtagaaatagttcgattagaccaaaatcctttttatacatgtattcgaatttgaagtgagggggaagcttgatggcagattttgttgctagtttgaatgcggtcttatggagtacgcccgtcatttatattttattgggaattggattcaccttttcaattatgacccgttttttacaagtccgacatttaaaagaaatgattgttcagatgttcaaaggcaagagctctgaagccggcgtttcatctttccaagcgttatcgattgcgctgtccggccgtgtgggcacaggaaacatcgcgggagtggcgacagcaattgcattcggcggacccggtgcagtgttctggatgtgggcgattgcctttatcggggcggcgagtgcctttgtagaatcaacgcttgctcaaatttacaaagtgaaacaagacggtcaatatcggggcggccctgcttattatatagaaaaaggcttaggcattaagtggtttgccgtcttatttgccgctgctgcccttattgcaatggcctttctaatgccgggcgtacagtccaactccattgcggctgggatccaaaatgcattcggcatctctcctttcgtcacagggtgtggtctggttttattattagggttcattatttttggcggcgtcaaacgaattgccaatgcggcgcaaatgattgttccatttatggccattggatatatcctgctgtctttgattattattgtcatgaatgtgtctgaattgcctgctgtgatctcattaatattcaaaagcgcctttgcattggattccgcttttggcggcttgatcggcatggcgatttcctggggcgttaaacgtggcatttattcaaacgaagccggccagggaacaggcccgcatccggcagctgctgcagaggtttctcatccggtcaagcagggactggttcaggcattttctgtttatattgacaccttgtttgtatgttccgctacagctttcatgatcttgtttaccggcatgtacaatacccaggctgcagatggttcctttatcgttcaccagcttaaaggcgtagaagcaggacctggtttcacacaagcggcaattgacagtgttcttcccggattcggtgcaggctttgttgccatcgctttattcttcttcgcttttacaacaattatggcgtactactacatcgcagaaacaaatatcgcctatttagcacgaggcagagaaagcaaatgggcgatgcttggcttaaaactgattattttagccgccacgttctatggtactgtgaaaacagcttcacttgcttgggcattaggggatgcagggcttggcattatggtatggctgaacgtcattgccattgtgctgcttgccaagccggcgctccttgctttaaaggattatgagcgccaaaagaagcagggcttagacccgatctttgatccaaaagcgctgggtatcaaaaacgctgatttctgggagaaagaatacactcatgaaagtgaacgtgtctcctgaacatactaaaaccggcccgatatgacctcgtgccggttttttatgaacgatagtttgtatacacttcttgaacatcatcgtcatcttcaaggacgtctattaatgtttccagcttctcaacagcctgatcatcggcttctgcataggtattgggaagcatggtcacctccgccgaagaaattggatatttcgattcgagggctgttttcacctcttcaaaatgctcaggctctgtgaaaacctcatataggttttcttcaattcgcagctcttctcctcctgcttcaagcacatcaagcatgagctcatcttcttctatttgccattcagtacggtctatcgtaatgaacccctttcgttcaaataaaaaggctacacatccgctttctcccagacttccgccatttttattaaaggctgtccgcacatttgacgccgttcggtttttattatctgttacgcattcaaccatgacggcaatccctgaagggccgtagccttcataggtgatttcttcatagctgcttccgtcttggcctcccgcagcttttttaatggcccgatctatattttcattcggcatattggcgccttttgctttttcgatgacaagacgcaatgctgaatttgcttctggatccgctccgccttctttcgctgccacatagatttcttttgccagcttcataaatattttcccgcgctttgcatcctgtgcattttttcttttttgaatgtttttccacttggaatggcctgccatgttttcaccttcttttacattttctatgtacactttaatgggaattgttcgctgatgcaaagaaaaaggctgccgaatatccttccggcagcccttccttcctagcggttgttcattttatgaagttttctgaacagccctttatctgttgatacttggacgtcacggccatttgcatagttgcgcgctgcttttacgacattatctctgtcagactttgtgaactctctgtggcttttgactgcgataactactcggtcatcggataccataacttgtgtgtcattgacgtttttcacttgtttcacacggttggcaatttttgcagccagtcttctgttttcttggttgtcatacccgttgttcgctgcattccgattcatgtttcggttattcgtgttgttatatgttccgtcagttgccaaaggaacacgatcgtcagcagtaacacggtcacggttatttacattcgtggtgtttcggttaccgtcgttctgatcctccattaattcagaaacaggaccatcgtggtcgattccgtctccctgtctatcggcgtcattttcatttgtataatatccgattggacgggtattgccgttattgcgcgtatcattcatagcattatcgtttgctccgcatgctgttaagccggctgtcattagaatcaggctagcgatcgtcatttttttacccaatggaaaaaccccccgtggacgaattgagcatgtttgctcgcttttatcatgtgcgtatggggggcatgttaagcgtgtcagttctctccatttggcagtgatcagcttgaaaataaaaaaaggaacgatttacatcgttccgaacaatcactcattttcttcttccggccggccaaacatttggtttacagaaggctggttcgtcattggcatagaaactcctgccgaatatgggtttggatttgggttagctgtgccatatggcatattagggcttccataagctcccattcccgaatggccaggcgcagagaaatatggctgatgatcaccgtcacagccgcagtcgtcatgatctttgtatggcatgtaaccatgagccgcagcaggctggtatgctcccattacttggggagtgccgtaataagggccatacggcatatgtccatacggagatccataagccggagatgcgtattgcggcgcaccgtatgaaccgtaatgtccgtgatggctgttttcatgatgctggttttcataacccgggtcatactgaggcgatacaaatcctggctggtatccatgcatcggatgcattggataagcttgtgccggatagtacggatagcataatcctgatcctggaagaattggcgaaacaggcaccggacacggtacgaaatgagccggataatgataataaggctgaacagccggcatcggcatattcggaactgtgtgatgaacgttttcctcttctacaccgcctacctctggcgcctttggcatattaggcatattcggataattagcattttccatattactcatagcctcctgttgtggaaattggtcttgcatatgatacatatgatccatatttccgtcatgatgtttttttggctcctccggtttaggaggcgaccaaggctggaaaagctgtttcatatcataataatcgttcacatcagcttcagggtacacattttcctgcaaattaggcatcggcgggacatacggcatggacttcttttctttcggctttgtgtcttctacatcgacaacggatttaggcttctctttcgcatatggatgttcttgcttcacactcccggccgcaggacttttgcccgcttttggctcttttctgaccgggactccttctgacggcacttttattttcattccaggcatgattaagtctggattgctaagctgtgtattgagttttttcacttcctcaacatcgactccgtacttttcagctattttccagagcgaatcgcctttttgaacgatatggattttcaacgttttcccctcctatgcaaaacgtgaacagttcagctgtgattacaatatgtttcttcacaacatatgcctgaacaaaagaagttatgagtaaaggaagggaaaatatttctgatctacgtgatcgaaagcattcgattcagggcaaggagtgcatcttcctgaatggcttttggcaccttgatgacgcctgaaggttctcctttttcaatttgttccagcgaccacaacaaatgcggcaaatcaattcggttcattgtcaggcaagggcacatgtcagggttgagtgattcgatttgtttatctggatgctcgtgaatgatccgcagaacaagattcatttctgtcccgattgcccacttgcttcccgccggagcctggttgattgtgtcgataatatatttcgttgatccgttatcatcgcttagtgtcacgacttcgtgtgaacattccgggtgcacaatgatctgaatgtcggggtctcgctctctcatatcatggatatttttagtggtgaatttctcgtgaacagagcaatgccctttccacaaaatcactttcacattcgtatgcccggattcagctactaattcatctttcatcggatcccacacagccatatcttcaagcgcaatgcccagatcataagccgtatttctccctaaatgctgatcaggcaaaaataaaattctttttttctgtgtaaacgcccattcaagcacttttttcgcattcgaagaagttacagttgctccgccatgctttccgacgaatgccttgatctccgcagtggagttcacataagttaaaggtatgatcgtatctccaaatatatgctgaagcttcttccatgccctattggtctgctgcatgtcagccatgtcagccatagaacatccagctctcatatctggcaggacgaccgtttgctgctcgcttgtcagcatatcggcggtttctgccataaagtgaacgccgcaaaatacgatataatccgcttctttgtttttttccgctacttgggccaattgcagggagtcgcctgtttggtcagcaaattgtatcacttcatccttttgataatgatggcctggtataaagagcctgctgccgaactttttcttaatggcggcaacgcgcgtttccatatcctttctcgatagttctttataactttcgggcatcatatcattcgattgtttgatcacatcaagaattgacataacggcattcctccacagattcatttgataacgtaacatccatgctgatatctaaacttttgacggaatgagtcagaaatcctaatgaaatataattcacacccgtccctttaaaagcaggcaaagattctaacgtaatcccgccagaggcttcagtttttatatgagccggtgtgagctttgcaaaatgacggaccgtatcaggcggacagttgtcaaacataataacatccgctccagctgcaattgcttcccgcagctgtccctccgtttcaatttccacctcgatatttaccatgtgccctgcggcctgacgggcttttttgcacgcctctaaaatagagccgcatgctgcgatatgattatctttaatcatgatgccgtcatacaaaccgaatcgatgattatacccgccgccggctctgacagcatatttctccagcattctgagccccggtgttgtttttctcgtgtcacaaattttaatctgttcatcatccagacaccgaacagcctctcttgtcattgtcgcaattcctgacagtctctgaataagatttaatacgacccgctctcctgaaaggagcgcagctgcgggaccgtgtaactcggcaatcacttcacctttatgcaacatgtccccatcttttttgtttaaaatgatttgaacattttcgtccaataacgaaaagccttcttttatgatcgctgctcctgcaaaaataccctctgactttgcaacaatctccgcttcacagctctgttctccaaaaatagactgcgatgtaagatcccctgtcccaatatcctcaagaaaaaagtgattcagtaattttttcagctgtaaatgattcattgttccaaatcccctcgttttttctgatcttcgttcctttttttgtatggacaatttgtcttccttgccagcccacctcagtatgaggaaaatcggttcggaagtgagcccctctgctttcctcccgcaaaagcgcagaaaacgtcatcagctttgcagtttgccatagatgagaaagttccatctgccgaattgtgatatccttcacatttacttcctgaaaaggcagcgtatgaagccagatgctaagctcaatcaaactgctttgttcccgcagaatagacatgtggcttgtcattttgctttgcagttcatgcacctctatatccggcacctcgtagaagacactggtttctagccctgattgatattgcctgttataagccggtttttggataatatgctctgctgccctttttccaaataccagcgcttccaataaagaattgcttgcaagccggtttgctccatgtaaaccggagcatgctgtctcgccaatcgcataaagccccggcactgtcgtttctccccagcgattaactgaaacacctcccattaagaaatgcattcccggagcaacaggaatttttccgctgtggatatcaatccctgctttttcacaaatagcggtgatagtagggaaacgcgtttcaaaatcagaaatcgcactgaagtctatataaacgcgatttccttttgccatttcttcgtgaataacccgtgagacaatatctcttggagccaggtcacctaaaggatgccgttcagccataatcctgcggccgttttcgtctactaaacatccgccttcccctctgacagcttctgaaacaagcccgtagaaaacaccatttttcacaagcagtgtcgggtgaaactgagtaaactccaaatccgttaattccgccccggcccggtaagccagagaaagaccgtcacctgtgacagtgagatcattcgtatggtgaagaaacaggtttccacagccgccggcagccagcacaacttcgtctgcgtgccttaccttgagccgccctttgctgtcttttgtcatgacgccgatacatcgtccgtcctctataagcaaatctgctgccatttcattctcgattaacttgattttgctgttgatccgtttgagcaaataatcgataagcagcctgcctgttgcgtctccgcctgcatgaaatatgcggttgtatgagtgggccccttctcttccaagacaaacaccgcctcgttcattgcggtcgaatggaaatccacgctccaataggctttgaaccatcatttttccatcatgtaatacgtctgctgcaatagctagattattatggccgcatcctgcgtataacgtatcctccagatgggcttcaatcgagtcatcttttgcataggccgcagcaatcccgccttgtgcatagacagaattgctgtttttgacgcttttttttgtgataacagtcacttcgtatgagggcgggaaagctgcagctaaggaaagtgccgccgcccctgaaccgatgactgcaatcgtctttttagacatatgccatcctcctgttgtttacacctgtcttgacacctatatttacacaaggataaaataaactcaagagttttttatggagaacggatggaggaagaccggatgatttatttagattatgcagcgacaacgcctatttgtgaggaagcccttactgtatatcagaagcttagtatggatatgtacggaaatgccagcagcctgcatgatgcaggaggaaaagcaaagcacatactggagtactgccgtgaaaaaatcgccaacatcattggcggagaagcaagcggcatctattttacaagcggcggcactgaatccaattttctggccattcaatcattgctaaacggcctgccaaaaacgaaaagacattttattacgactgccatggagcatcagtccattcataattgcgctgcttttttggaacagcagggatatgatgtaacagtcattgaaccgaatgaatacgggcttattaccgaggaaatattactagcccatatccggccggaaacaggccttgtatctattcagcatgcaaattctgaaaccgggatcattcagcccattcaccgcctgtcttcatacctgcacaataagggcattcttcttcattgcgacgctgttcaaacgtttggaaagatcccgatcaatacaaaaaatctgggagtagatgcactctcaatgtccagccataaaatccacggtccaaaaggagtaggggcggtctatatccgtccggatgtcccttggaaacccgtttatcctctgactactcacgaatacggattcagagccggcaccgtaaatgttcccgggatcggtgccttcactgccgctgcagaattgatcgtaagcgaaatggaaaaacagatatcccgcaatgaggcattaagaacttactttctagaccaaatccgtattcggtctctccctgtaacccttgcggcagacacttcgcaagcagaatgtcttccgcatattatagggtgtttttttcactcatttgaaggacaatatgttatgttagaatgtaatcggagtaatatttgcatttcaaccggcagcgcttgttctgcaggttaccacggtccgtctgaaacaatgaaagcattaagaaaaaccgaacaagaagctctgcaatttatccgcatctcttttggcaggcatacaacagctgaacagctggaacagttattacatacgtttacagtgctttgggaacaaaagaaaggagaatttgatattgaccgaagaattaaagctaatgggcgccaacaggcgtgaccagcttcttctgtggctgaaggaatctaaatcaccgctgacaggaggagaactcgcaaaaaaagcgaacgtttcaagacaggttattgtacaggatatatcgctcttgaaagcgaaaaatgtaccgattatcgccacaagccaaggatatgtatacatggatgcagccgctcagcagcaccagcaggcagaaagaatcatagcatgtctgcacggtcctgaacggacagaagaggaactgcagctcatcgtcgacgaaggcgttacagtaaaagacgtaaaaatcgagcatcccgtgtatggagatttaactgcagccatccaagtaggcacccggaaggaagttagccatttcattaaaaaaatcaattctacgaatgctgcctacttatcacagctgaccgacggcgtgcacctgcatacactgacagcacctgatgaacatcgcatcgatcaagcttgccaagccctcgaagaagccggcattttaattaaagactaaaaaaagccctctagagggcttttttataattggtaagactggtatgcacccaggagctttactttgcagccgagcgcttcaagctcctgcatggcccctggaatcaatacatcatcaaacgctttctcaatatcaataataaagaaataatggcctaatccggttttagtcggacgtgactcaatttttgacaagtttaaatttctccaagaaaatgcagacagcactctatgcagcgccccggactgatcatcctgcggcagcatgaccattaaggtcgttttgggcctagaactcaattttgaattcacttcaaaagatatgttttcatcaggagacaggataacaaatcttgtatgattgtccctataatcctgtatatcccgtttcacgatttttaattcgtatgtagaagctgccatatcattggcaatgaccccgatattcagctctggatggtcactgacaaactttgctgccgccccggtagaattggcgtattcatatggaacggaaggaaaatgtcgatggagaaatttatggcattgcgcaatcgcgtgtgaatgcgagtaaattctgtcgagctctttccatgcattctctcttgagggatgaacgagcaagtgctgatgaatcggcaacgtcatttcacccacgattggcaagggctgttcatgtattaaatagtctattgttagattaacagatccttctaaagcattttccaaaggaacaaaagcaaaatcaacttcgcctgcaacggctgcatctatacactccggaatggtgcggtaagcaacatgttcggcgccgttttgaaaacaagaactgactgctagatgtgtaaatgtagctgctggacctaaataaccgactttcatgacgattttctctcccttatgcacctgaacctaatatttcaaccttttctacaaaatcaaacttcctgagcttattcattaatgtatgaatgtcttcttccattgccgacgtactgatagacagtgtcacatttgctctgccttgaagcggaatggtctggtgaatggaaagaacgttgcttccagaatcagctaccgcctgaagaagctgagataacgcacctgacctatcctccaaatgaaagaaaagtgtgataatttgttcttttaccatggtgtagaatggaaaaacagcatccctgtatttataaaacgcacttctgcttaaatcgaccttttgaacggcatctgctactgaatctgctttttttcgatcaagcagctttttgacttctaatgtttttctcattgcatcgggcaatacatcttcacggacaagataaaatgtctcctctttcatttgcatcccccctttaaaatagagagcctggcaccaggctctcttttcagccaacattcattaatcaataaattcaaattcaaattccagaagcctgattatatctccatccttggctccgcgttctctgagtgcttcatcaacacccattccgcgcatctgtcttgcaaaccgtttaaccgattcatcacgtgagaaatcagtcatcttgaataaccgctcaaggctgtctcctgaaagcacaaatacaccgtctggatcgcgtgtaatgttaaatggcacttcttcattttccatcgtgtacatgacacggttttgtgtaagctcttcctcgtcatacagcgggaattccggtgtgttctcaagctgattggcaacctcaaacagaagctcacgcagaccttctcttgtcaccgcactgatcgggaataccggataatcatccgtcagcttttctttaaaggcttcgagattttccgcagcctccggcatgtccattttatttgcaacgataatttgcggacgctcagtgagacgcagattgtactcgctcagctcctggttaatcgtaagataatcctcatacggatcgcggccctctaagcccgacatgtcaatgacgtgaacaataaccctcgtccgttcaatatggcgcaaaaactggtggcccagtccgatgccttggtgtgcgccttcaatcagtcctggcaaatcagccatgacaaagctgcgtccgtcatccgtttcaaccatgccgagattcgggacaagcgttgtaaagtgatagtccgcaattttcggttttgcagatgagacaacagacagcaaagtcgattttcccacactcgggaacccgacaagcccgacatccgcaagcacttttaattcaagaacaatgtagcgttcttttcccggctcgccgttttctgaaagctgaggcgcgggattagccggtgtagcaaagcggctattccctcttccgcctcttccgcctcttgcaatgacagcccgctgtccgtgctctgttaaatcagcgatgacctgttttgtatcatcgtctgtcacaacggtgcccggcggaactttaataaccatatcatcagcatttcgtccgtgctggtttttggacatgccatgctcgccgcgaatcgctttaaagtgttttttgtatctaaaatccatcagggtgcggagaccttcatctacttcaaaaacgacgtctcctcccttacctccgtcaccgccggcagggccgcctttcggcacatatttttcacggcgaaacgcaaccataccgttgccgccgtcgccgccttttacatatactttgacctgatctacaaacataatgtcctccgttctaaaccgttaaaaactccgctagtccaacccaatctcaatcagacattcgtgactcgtgatttcaaaacgcatgatatcaacgtcctcatatccattctgccgaatatcatcaaaagcagatggatcggcaaaggcgccgtgaaaatcaaggtacagaatcagctgtctgtcaggatgatccgtttgaagcgaaaccgttaaatgattttcactctctctgctgactgcttgatcaaacagatgaaacagctttctcatcagtttcgccagcttttgatcataagccgacaaatccttaatttctccgagaacttcatattcaagcgtcatataatgggttttccaattaaacgtaagaaaatcaaacgccaaatgcggtgttttcaggtttgagagctttgattcgtgctttgcgtctataaccatttcttcaatcatttcaaagacgcggtcatacttctgcaagcttaagtttcctttaatcagctgcagcttattcatccaatcatgccgggaatggccaagcagatgaatcagttcgtttgttaatgccgtgtcgcttatattttcttcttgattttttgaaacatccttcattttcgcactcccaatcatttaatttcttatttaggagtctgtataagtgtgtattatgaattataacagagaaggctttgttagaaaaacaattgtttttcccagaaatatcatgttccttttttctggctttggttgatttgcagccaggcagaacattttatgtattactgcttggggaacatatccagtgggtttgagatgtttattctcattcttggcggggtctgctcgcacatactctgcatttcattctaggtgtttactccgcatattgcaaaaaaaactccagtcatcatcgaccggagttttttgaatcattattgagctacaggatatacgctcacttttttgcggtcacggccgaaacgttcgaatttaacagttccgtcgattttcgcaaatagagtgtcatctccgccgcggcccacgttttcacctgggtaaatttttgttccgcgttgacggtaaaggatagaaccgcctgttacgaattgaccgtcagcacgtttagcacctaaacgtttagcctcagagtcacgtccgttctttgtagaacctactccttttttagaagcgaaaaactgaagatctaatctaagcatgtagctcacctcctatattatgtttgtggtcacacgcaagttgtctttgtaatcccgttcgattgtctccagcgaaacaatcatgccttcaatcagcaactgagctttttggcgtgcctctggatcaagagattcagggaattcaaaataaaaataacccccgtcctcccctatatcaagaagcggctcgaagcccgcgagcacaatgaccgcgttaacggctccaaacacaacggctgtcactccggcacaaacaagatcttgtccatgttcagcaaaattcgcatggcccgtcatttcaaaagacaatatgcctttatcatgagacctcctgattgttgcctgaatcatgcttacgcgttgattttttcgatcgtcactttagtgtaaggctgacgatgaccttgttttttatgaacgtttttctttggtttgtatctgaaaacagtgatttttttcgcgcggccttgtttttcaactttagccgttactgttgcgccttcaactgtagggttgccgactttcacgttgtctccgccaacaaacaaaacgtcttcaaaagtaactgtttcacctgcttcagcagcaagtttttcgatgtaaacagtttggccttcttcaactttgatttgtttaccgcctgttttaatgattgcgtacattctctgcacctcctattagactaagactcgccagataccagggggctgtaaaagctcttaacacctgtactgagcggttgtagcaatggtgctacatccataacattaaaaaatataccaaaatacaagccgtttgtcaatcagttttagtagggcagaagcagttcctccatggaagaattcgtccgcttatcggcaaagtaagcgtgcagcacttcattctcgtcaagctggctgagcttttggcctgatttttctataataatcggatgcttacagccacgtttgaactcggccatcacatgatagactttatcctccgcctttactgtcagcggcagaagtttctcaagctccctgttttttccgtaatacctttcgaggagaaatctcacatggatatagtgcctttgccgatattcctcaaacaaggaaacagccagaaagacaaacaaaacccatgcgctgatctgcagaggaatcacgaataaaacccagcacccgagcaacaggcagaagcagagcgacgtttttagattaagccggtgagccttttgaaaaggcagctgtttggaaaacaacaaaaataacagttttcctccatccagcggccagatcggcagtaaattgacaaataagatagaaagattataaaaggtgaagagttcaaaggtatgctgatgaatcactgagacttctgcaagcatccaggcggcaaactgaagccagatgtgctgaagagggccggcaataatgaccgcaaactcttcctttaacggccgattcccgtgttcttccacttcgaccgttcccccaaacggcagcaaaaaaacacgcttgattctccaagaaaaaaatacggccagagcagcatgccccagctcatgaatcaatacaatcaggagcagacataataatgctttcatatggcctgtgagcaagcccagcgccgcgataatccaaagaaaaggatgcacatggatctttaagataaggtcgagccatttattcaaatgtaatcacctgaatcggatcaataaatttatcgccgtctttcatggcaaaataatagacccctttattatgatcatcaagcttaatcgaaccgagctttttgcctttatccacaaaatcatataaagcaacatccacatctttgagctcgccatagatactataggtgttgtcagcatgctgcaccttaaccgtcagtcccgtctggctgtctttgctgacttcaaccacatagccttcttttacactatcaatcttatcgctgcttgtttcgactttaattccttccccattgtcctgaaaatcctgctgtactttcccggatgcaggcgcgatcagatctttgcctacttcaatctgctgttccttatttttgtgttcaggagccaggaaagcaagcggatttccgaatttggtttcgaaccaatggcttgctgaagcaaattgaaattcagtttcaaaggttttggctacggcgggtttaatctgactgacgggtccaatgtttgttttataggctatagctgaaacgagaacaaggcaggccgacagaagacatttcaggataattgaatctgttttcaccaatgggtgttttccgttgaatgttggcatgttatcttcgtagaccggaagtgttccatgcttttcctgatccgttaccatcacccaggacgggggtttctgcttttcagaaactgtctgagtagagaaacgttttgagccggaaagctgctttcttcttttctctaatcgttttctgatttcatctgctctgtgactcattgccatcatcctttgcattcgttgggtttgtacatcatatgtcttgtccatggcaaatattcggtttagtcaggaacaaagcaggcaaaaacaaaaaaacctgacacagcatttgctttgtcagattcttctctttaattctatcacattaagatcttacgccgaaaaatgacttaatcttagccatcattcctttattttgctcttcaagcacctgtaaaggaacagattcacctaagatgcggcgggcaatattgcgatatgcaatagaagcgcgatttttcgggtccatcgcaatcggttcaccatggttggaagctttgatgacttcatcatcatcagccacgattcctagcaaatcgatcgacaaatgctgtacgatttcgtcgatatccatcgtgtcaccgtttttcatcaggtgatttctgattctgttaacaacgagccgcggcggttcaatattttcctcttgctccagcagccctataatacggtcagcatcacgaacagctgagatttcaggcgtagtgaccacaatcgctttatcagctccggaaacggcatttttgtacccttgctcgattccggcaggacagtctatgatgacatagtcaaattcctgtttgagctcttggaccatgtttttaatttgttcaggagcaacagctgtcttatcgctcgtttgagcagcgggcattaaatagagcagatcatcgaaacgtttgtcttttacgagcgcctgatgcattttgcatctgccctctacaacgtctaccagatcgtaaataattctattttcaagacccattacaacatcaaggttgcgcagtcctatatcagtatctactaagcatacgcgcttccctaaaatggctaaggcggtaccgaggttcgcagatgttgttgtcttacctactccgccttttcccgaagttattacgatagcctcacccaattcacattcctccctcaagccttgttagatcaggtcttaaatgagccaaatgttgaaggcgttcaatgaccatatttccgtctgtatctaaataagcacattccatttcgttccctttttgaatgtggtctggggagcgatttaacacatgattgattcttaattgtgtcggaagcatttcagaggcggcgatgaccgcttgattatttccattaaacccggcatgcgcgattcctttcagtgagcccagaacaaaaatgttccctccggccctgactgttccgccgggattcacgtcaccgatcaggagcaagtcgccttttacctgcagcacttggcctgaacggacaatttttgaaacagaaataatttcggcttcctctcttatctgctgtgcttcttttttagtaatgacttcactgtcaatagaatgaacaaacaaatctttctttgacgcaatcaattcggttagctgttcctcttgctccttatataaaaagcgatttcccagcttaacatgaacgctgattttctggccttttccatcggtatattgttcaattgacagcatattctgaagaccatcgagaagctcatcaaaagaacacgcatcatccagatgcaatgttagtccattctttgttccttttattgttacatattgctgctttttggtcttcacaatattcacctcaacaacatactcatttcgtcaaaaaaagataaaatcctttttactcatctctcaattctttctttagactcataaaaaacaatctaaatggcagaacaagaataagagctgctgcaatatttaataaaattgtcggtataaaccggtcaagcacaaatccgttaaacgtcataatatctttatgaatcaaagactgaatgccgaatacgtaaaattcgagcagacagacagccagaactgctatcaatatcactacaaatgcgtttgtatgtaacactttaaacgcttttgaagccaaatagcatagccctgcaaaaccaaacatgtaaacgcctaatagacttgtatagttcatgtcatatagaaaaccaaaaataaatccgtaaatcatcgcgtgtttttggttgataaaagccgacatgaatatcaatacaagcatcaaaaaacgcggggcgagcacttggtcatctgtaacgaaaggaaaatgcaccaaatctgtaaaaatgctttccgcagaaaaaacaagcatcataacgaaagggagaaggaaacgtttcacgatccttcctcctctgtatcgacagtcggcacgtcacggttaacaacgatcacattatttaaatctgtaaggtcagccgcaggttttacataagcaacctttgtcagtccataggaatctgactcgatatcagtcacttcaccgattgtcagcccttctgggaaaacaccgcctgtccctgatgtttcaataagatcgccttttttcacgtcttgtttatccttacgctcaataattgtcatcttaagacgttttttctctttgtcatatccttcgatcaagccgtagcctttgctgcctttttttccggaaatttttgtcgcgactctgttattgcggtcagtatcgcttaaaagctgaacagcagacgtaaaattgttaagtccggagcttttgatcttgccgattaatgcgcctttttcgtttgtaacggccatatctttcgctacgttttgctgagtccccttgttaatggtgacctgtttggcccaattatcagggcttctggcgatgaccgttgctaaaatcggcttgtaatctttaatcgatttgacatggccaagctcgtcacgcaaggatttgttttcttcttcaagctcttgaagcttggcttcatattgtgtctgtccgtcaagtttttctcttagacgctcgttttctttgtatgtgttttttaaatcattgatgttctcaaatattcctgcaaaaaattcggcaggcgtatgaaaaatattttgaaatactcccgtcgtatcgccgatcactttctcaggccaggtggtattgcggccgcccttcagcgaaaatccaatcatagccaccaatatgataatacacagaagtaatagcattaaccgcttattcggcatcgtgttacacctcttctattgaactcccgattatctagttttccctttgaaaagatggatgtgctccagtgctttccctgttccgatcgctacacaatcaagcgggtcttcggcgataaggaccggcatttttgtttcttcgctgatgactttgtctaaattgcgcaaaagcgctccgccgccggttaacactatacctctgtccatgatatctgctgcaagctcaggcggtgttttttcgagtgtgctcttcactgcttcgacaattgtagatacagtgtcgcgtagagcattagaaatctcttttcctgtaatttcaattgttttcggcagacctgtgagcaaatcgcgtccgcggatttccatgttgtcggattcttcaggagcttctgcagatccgatttccattttaatcgcttcagccgtacggtcaccgatcatcaggttgtacgtttttctgatgtagttgataattgcgtcgtccatctcatcaccggctacacggattgactgagacgttacgatgcctccgagggaaataatcgcaacttctgtcgtaccgcccccgatatcaacaaccatgcttccagtcggttcccaaactggcagattggctccgattgctgcggcaaaaggctcttcaatcggatacgcgtcacgcgctcccgcctgtcttgtcgcatcgataacagcgcgttcttcaacagctgtaatgcctgatgggacacataccattacatatggttttctggcaaacatgcctttattttttatggcttgattgatgtaatatttcatcatcgtcgccgttgtttcataatcagcgataacgccgtctttcatcgggcgaagagccaccacgttgcccggtgtccgtccaatcatatttttcgcatcatttccgacagcgacaatcgatttcgtatccgtctgcaaagcgacaactgacggctctctcacaacaattccttttccttttacaaaaacaagcgtattcgcagttccaagatctataccaaggtctctagcaccaattccaaacatatgtatgtatcttcctttcttaaagcaaaaataccctaaagggaaaaactcataaactctattatagcttaattcgacgaaaaaaaaagtgttacaaatatcctttttcctttaaactcacaaattttttatccccgatcaccaaatggtcaagcagctcgatgccaatcaggtttccgcattcaaacagccgtcttgtcacttcaatatcctccctgctcggcgtcggatctccagaaggatgattatgaacacagataaaggaagcggcagatcgtttaaacgcttctttaaacacctctcgcgggtggacaatagatgaattcaggcttccgataaatacggtgcgtttatggatgacttgattttttgtatttaagtataaacagacaaaatgctcctgggttaaaaagcgcatatcctccatgacgagattagcgccgtcttccggggagcgaataacgaaatgttcttcgttggctaatttgtgaatccggcttccaagctcaactgcagccagtatttgaatcgcttttaccataccgattcccgggatgcttgacagctcttcaaccgatgcttccttgagcagacgcagcccgtcaaatgagcgcagcagccggtttgacaggtccaaaacagattcgtgtttagtccctgtccgcaataatatagccaaaagttcatgattcgctaagttctcggctccgactttcaggagccgttcccttggcttttctttcattgggaaatctttgagttttaatggcagatcgcgtatgaccaagcactccttttctttcccttcccgtttatagaaccgtcatgcccttatatcaaaatggcgaagagctctcattgtttttgatataggaaggcccatgactgaataataatctccgtctattttctttacaaaaagcgcgcctcttccttggatgccgtatgcacctgctttatccatcggctcttttgtttcaatatatgtccaaatctcttcttcactgagggaccaaaacgcaacttctgtcttatcataaaaagtctcgctgtgattttcagcttgaatgctgaccgcggttattactgagtgacttcggcctgaaagcctccgcagcatagaagcagcttcttcttgatcctgcggtttgccaagacattcgccgtcaaggcataccattgtatcagcaccgataacgattgcatgcgggtggagatcagctacagccttagctttttgttttgccaaccattggacgttttcttctggtgaaaagtttcgatttaatttttcttctacttcactgacaataatggagtagggcagctgtagaagatcgaggagttctttcctgcgcggagattgtgatgccagtattagcggttttgtcatgttcgtcatcctttcagggtttgcttaagaaaaaaagatactcgtttatcctaccaaatcacgaggcttgtcacaatttcagaaaaataactttttcatgacaaaataaaaaaagcctgtcactaaaggacgaaggctcagggcactatctcttattttacgacggctaacagctcctgctgagccttccacccggcttcagcacttggatcctctaattcctttaaagcctgcaaaatcgcttttttctctcctgtttctgacgcttttgtttcaccaagcgacttttctattttctctacactcgcttttgtaatgtcttcgccgagaatcgcctttgctgcaagctccgctgtttccttaaaagaatctgtcatatctgactctattgataaggaaagctccttgcctccccaggcttcaaaatcactgtcgattaaaacctgtcctaactgctgtgagacatccttatcactggctaagcccgcgatgacatacgtatacccgtcatcctttgacagtgacacggcggaatatcctttttcggtcaattgttctgttaacgtttcggcgcccttttcatttgaaaattttccggcttgcacagcgtatgttttgtatgtaccttcagtttgtgcttgtttttctgcgtctgaggtttgtttatcagcagaagtatcccctgcttttgccgtttggctgcctagagaatcctctaaagaggccggtgctgacgcttctttattccccgatatgtttaacgcgaataaccctaatccagtgccaatgacagccgcgaaggcaatcgtcgcagccactctttttactggtttggcagtcccggtctttccttttgcataagactttgtttttttcttttgataaggaggaacaactttagggtcctctttaaacaccttgtccccctcggaatcccaattgaattcatcttcatcagggtgttcctgggatgccgcaacctcttgttctgcctgtcttttttcctcccaatttgaaaatgtcatgcttctatctgcctctgtatcaggtgtctcttgttcgtaaaccgtctcttcttttccattaatcgtcaccttgagggctttttctgcggctttactgttttttttattctttctttttttcaattccgcttcctcccttcatttgcttgaccgttcttgtcggcttttcatgctacacactttagcacaggcaaagaaaaaaagaacaagacttttgtcgccttgtccaaaaaacgttcgtcaaatttttcagcagtcagcccaatgccattttgatataaaaagaaatgatagagtcaccgtataaataggctaaaatgctccctgcggccatagcgggggcgaagggaagcggctgccttttagcgagtctaccagtcagaacagctgccgctccatataatgcacctatcaaaactgaaaagaaaaaggcagctgccagcattttcacaccaagcacaaagccaatcaccgcaaataatttaatatctcctccccctactcccccatgggtgattgcggcaattacagccagaaatagaaatccggctgccgcacctagcaggcctgcataccaggaatcaagcggagaaatcaatctcgcggccgccaaaaagggaagaaagaaaatcaatattcgatttggaatcagcataaaatgaatatctgtcactgcaacaataatgagaagagagataaacaccacagcgggaaacagttccagcgatgtgccaaagcgtattcctgcggcagcaaataaacacgctgtcacaagctctgctgcgggatacataaaagaaatcctatgcccgcagcttttacatttacctttttgaaataggaatgacaggatgggaattaattctgcaggagttaatgtccgccggcaaaacgggcatgatgaacggggcgcaataatagatagatgtaaggggatacggcacccggccgtatagtaaaaagaaccaaggatcagcccaaagataaaaagaatggatagcatagacaacacacctttactcattgagttctggtatggattgtagcaaaatggacatcctgagctccaattgggaatattcaattttacacataaaaaaacggcagaatcttttttttgattctgccgagccggatgcttttatttcaacctttttcgaatgtcagaaataaagtaaagagatccggtaatcagcacaatttcatttgagccctttttgctttctatgaatttgatcacatcgtctggatcttcactccagcttttattgctgatttcacttgcatcatagagatcttttgcaagagaagcacgcgggaaatcaaaagaagcaaaatgcatcgcatgagcaatggtttccagtcttttaatcatgttctgatacggtttgtcctttaacgcgctaaacaccacagaaatgcgtgaattggcgaaacgctgcttcatcgtttccgccagcttttcaacaccttcttcgttatgcgcaccgtctaaatataccggaggatgctcctgaacaagctctaaccgtcccggccaagcagccttcacaagcccgctccttaacgcttcgtcactgatatgggcgatattctccttattgagccactccgcagccaaaatggacaaagcagcattttgtctttgatgggtgccaatcagagatgtccgaatatcttcatagcatttctcttccgttttgaatgaaaactgttctcctgcaggcagagcctcttcattgaaaataacacatgcatcatgcaatgactggaacggcgcagcatgccgttcggcttcatggcggatgacctgtaaagcttccggctgggtaactgctgtaacgattggaataccttctttaataataccggccttttctcctgcaatttcttcaatggtgtttcccaaaatattcatatgatcgtgtccaatgcttgtaatcacagttaagagcggttcaaccacattagtagaatcgaatctaccgcccaaacctgtttcaaaaataacaaaatcgaccttatgaaattctgcaaaatataaaaatgcacaggccgtcataatttcaaattctgtcggctgtccgtattccgtttgatcaagggcttcaacgtgcggtttcatttgattgacgagtgctgtccattcctcatctgaaatcggtatcccgtttacgctgatccgttcattaaacgtaataatataaggcgatgtaaatgttccaaccgtatatccggcttcctgcagcatagaacggataaaagcgacagttgatcctttaccgtttgttcctgcgacgtggaacgctcggatttttttttcaggatgtcctaaccgcgccatcagctgtttcattcggccaagtccgggcttcaccccgaatttcagcctcccgtgaatccagctgcgcgcatcttgatatgcagtaaacaatgataatcccctcttttataagacaaggcggtttctctagaaaccgccccggcttttcattaacccttcagctcagccattcgtttttgaacagcgtcacgcttcgccacataatctttttctttttcacgttcttcatcaattacgtgtgcaggcgcttttttcataaatccttcatttccaagtttcttttggacacgctcaacttcttttgtcagtttatcaaattctttttgcagacgggcaatttcttcatcaatattgattaagccttcaagcggaagaataacctctgctcctgagacaacggccgtcatcgccttatcaacagcctcaatatcggtgccgattttaagcacactcggattcgtaaagcgttcaacatatgaacggttcgcttcgaggcgggctgctatttcgtctgtgcttgttttaatgtacagttcaacctgcttgctcattggcgtattgacttcactgcggatattgcgcacagaacggatcagctcaacaagaagcttcatgtcagctgccgcttcagtatcggtatgctccggcactactacaggccattgacttactgtaatcgattccccttggtgaggaaggtgctgccaaatttcctccgttaagaatggcataaacggatggagcagacgcatcgtttgatcaagtacgtaagcaaggatggaacgggtagttttcttagccgcttcgtcttctccataaagcggaagcttcgccatttcaatataccaatcacagaaatcatcccaaataaagttatataaatggcgtcctacttcaccaaattcatatcgatcagcaagctgggtcacgtgctcgatcgtttcatttaatcgcgttaaaatccacttgtcagcgactgacttttcgcctgagagatcaagctcatcgtacgtcataccatccatattcattaatgcaaaacgggaagcgttccaaattttattggcaaaattccaggtcgattccactttttcatagctgaagcgcagatcctggccaggagagcttccagtcgcaaggaaataacgcagagaatcggctccgtacttgtcaatcacatccatcgggtcgacaccgttgccaagagatttactcattttccggccttgctcgtcacggattaagccgtggattaaaacatctttgaacgggcgctcgcctgtaaattcaatgccttggaaaatcatgcgtgatacccagaagaaaatgatatcgtaccctgtcacgagaacatctgtcggatagtagcgtttaaagtcttcagcagttacatcaggccagcccattgtggagaaaggccatagcgcagaactgaaccatgtatccagtacgtctgtatcctgttcccaattttcgctgtcttccggcgcttcaagcccgacatatagctcgcctgtttctttatgataccaggcaggaatacgatggccccaccacaattgacgggagatacaccagtcgcggatgttttccatccagtgtaaatacgttttttcgaaacggtcaggcacaaagttgaccttttcttctttcttttgcagctcaatcgctgcatcagcaagcggctgcatgcgcacaaaccattgtgtagaaagataaggctccacaacagccccgcttcgttcactatggccgacagagtgcatatgatcctcgatcttgaagagaactcccgcctcctgtaaatctttcacgagctttttgcggcattcaaaacgatccataccttgatattggagcgcattttcattcatcgtgccatcttcattcatgacaaggatgcgttctaaattgtgtcggttgccaagctcgaagtcgttcggatcatgagcaggcgtaattttcacggcaccagacccaaattccatatcaacatagtcatcaccgacaatcggaatttcacgatttacaatcggcaggatcaccgtttttccgataaggtgtttatagcgctcgtcttcagggtgaacggcaacagctgtatcaccgagcattgtttcaggacgtgtcgtcgcaatttcaattgagcctgaaccgtcagcaagcggatagctcatatgatagaatgcgccttgaacatccttgtaaatcacctcaatgtcggatagggctgtttttgtcgctgggtcccagttaataatatattcgcctctgtagatcaggcctttttcataaagcttaacgaatacttctcttaccgctttgctcaagccttcatccagcgtaaaacgttcacgggaataatctaggccaagacctaatttcgcccactggctgcgaataaagtcagcatattcttccttccacttccacgtttcttcgaggaatttttcacggcctaaatcgtagcgggatttgccttcttcacgaagtttcgcctctactttagcctgtgtcgcgatgccggcgtggtccatgccaggaagccacagcacatcatagccctgcatacgtttcattcttgttacaatgtcttgcagcgttgtgtcccatgcgtggccaaggtgaagtcttcctgttacgtttggcggcgggatgacgacagagtatggctcttttgtctggtcactgcccgcttcaaaaaatttgccttttagccaaaaatcatatcggtctttttcaaccgctgccggatcatatttcgtcggcattgtttgttcattcgtttccatcataaccctccagcatgtttaaaaatggctgagaacgaaaaaagagctcttcatccctgtaaaaggacgaaaagctctttcgcggtaccaccttttttcatgaactctatcagttcatgcacttataacggataacgggtgtttcccgaatttctctactcttctttcaagaaattatgctcccgggcgaccttccaatcagacaacataagaagcctttcagcaaacggcttctctctctgcatgcgccttttttgtactcttcccgttctaagcaggtgtatttatcagctcattgtacattatttatgttctttattatagtaaaagtgtttttgattcgtcaatcatcttttccaaaaacaccgctttctatacagatgggcaggcacctattgcccaagtttacatatgatgcttgtaaatgcgtagaggaggatgcaccgtgaagaaacgtttcagctcttattcgctgccgccatgggtaaggcaaattcggcttgtatccgcacaagtgattattcccattacgatttttcaaggaatcagaaccattttctttccgacaacctttgatgttttgctgctcgcaatcctaatctttttagcttgcgcccttcatttagaatggatataaacaaacaagtccgcgccattaagacgtggactcgttttcagcctgaaattttttctcttgttcaatctgatgaattttcatcacaaacggctctatatttttcatttgccaataagcctttaataattgtgtacattcctctttttcatgctgtcgtttcccagtttgataaccgttcagcaccttgtacatggctgccggatatgccatatagctgagaaaaaggctgacttccgcttcacgcaaagggaatgatttcgtatatccataaaaccattcgacgcattccggacaagctttcggaaagcctctgaacatttttgtataaaagccgagcaggtcgttttgcggaggaccgacagatgctctttcgaagtttgtaaaatatccggtcccagcatcattatacagaaaatggtgtatagacaggctgccatggttcattacaacccttgaaacgtccttttcctttgcagactcataccagtcctccagccgttccagcgcaaagttcaccgcggaaatggtttctgaaaaataggttatggcctggagttcaaaaggagaaaggtaccattccttctccgctctatccacaaactgctcatagaaaattttatcttgttcccacttttttttcgtttgcccgtaataacgttcaatctcatcacgtctaacctttagttcctgcgcggttctctcgtgaagacgggctgtttctctaaataaataagcatgtttctgatcccgttcttcctcttggtcaaattggagccaaggcattaaatagtaggtatctccgtattgtatgcctgctgagaaaaactcaccgctatttgttctgtaaacgggaacgaatgaacgaaagcctttttcctcaatcgccaccatatgatctgtaaaatgcttgccgcgaccttctttcaattttttcagggcaaatatgccgtagtctgtatacactttccaaacaagaggactgacaggctcaataaattgagcagtcagtccgtattcctgaagaaccgattgggtatcttccatttcattcaccacattttccgatcacttacggtttacgcatggctatttttatattgaggaatatagagaatctgtcctgcttttaattcatcatccaatgctaaagaattcatcctgatcagctgctgggatgtaatttcataccgttcgcataaacgctcgatcgtatcttcctgctgcacaatacaaattttcattctcgaaaactcatccgcttcttttgtaaagagttttgttaaataaagagaattatcactttcctttgtttgaggttccttcgtttcagcagcaggagcaaccctaggaacagcatccgtttccttcctttcagtctcagaagattcaggcagctggaaggattgaaaaggtgtttcttccttaggctcttcaggtgatggtgtttttctcacttcaatttcgaagctctcttcctcttgttcttcctcctccagcagcttaggcgctgaataaaaagaatcctcctcttcttgttcagacaggaaggtacggtatgccggttcaggcaattcttcttgagatgcctcctccgagcttgttttttgattgaaatggaaatgtaaatcggctttgtcattctccacatatgcagctgaagctgtttctctgctatcttctatggagagagcagcctctgatacactctccaaagcttcatccgcttccgcctcttcttggcaaagcgcaggatcagcctgatccgattgagctgcttcttcattttgagcctcttggcgcagcgcatattcatgattaggagacactgttgtttcctctttttcctttgcaatcacagtctctgaatgaagctcagcttccaaagcaggcgattcttctgctccagcgtgttcacgaggctcagtctctgctggagagtctgcttcttcacgaacatccgctattgcagctgccggctctgccgtttctttttttgctttaacgatctcttgaatctctatttctgaaggatcaggttctggctcagattcttctgtttccgattcagcacgaacctccttttccgcagcaagctcttctgactcttcttcctctttcacatcttctctggcctctggatctgaagcaaccgattcaggcggctcagattctgctttttctgtctccagttcttcacggagccccgctttcgagataaaaagttctggcggttcggctggcggttcatgctgaagaactgcttcctctgccgatgatgcacccggttcttctactacactatgtgccggcggctctgaaagctcttcctccctgaatgccgcaggagcttcatataaaggtatctccggctctttgtcttgcgtatcgtccaaaagcccttcgatcgctaaatcagcttgaattgttaaaatgcgcgaatccgtcaattgatagtcaaatgcgtcaataaagacgaagacatcctgtaaatggctcactttatttttcggaatggtaatatccacaggaaaacagtgagtcagttccgcacttccatcctctctctttctgacttgttcaacaaaccgcttatctgtataaatctcttcggtatgtttgttttgatctatgttgtactcacctgtaagttcaagcgatcctatgattgatacataatcatttacttcctgaaccctaatatcaggatctaatgaaatagaaagcagttcagaaacttcctgtcctttttggaaacagatcgattcttctacagaaaattgcaatcgatgattttgtggcaagttcatatcctcctttcatctaatccttaaaattagatgtcactaaaggtgtatgtatgaactggagaaaatatgagtgggagagcacgaaaaaaccggcacaaggagtccttgataccggttttcactcttatctgcggctgatctcagcaaatactttctcagctgcctggattgtgttttcaatatcttcatcagtatgggccgttgagaggaaaagaccttcgaattgtgatggcggaaggaataccccttcatttgccatccctttataatagcttgcgaacagcttcaaatcagatgatttcgctgtttcataattgatgactggttcgtttgtaaagaagaaaccgatcatcgaacctgcacggttaaaggtatgcggaatgccatgagcctcggcggcttttgaaattccttcttccagcctgtcgccttttttgatgaaattcttgtaggaatcaggtgtcagctgtttcaatgtctctaagccagccgtcatcgcaagcgggttgcctgacaatgtaccagcttgatagatcgggccgcttggagcgatctgctccatgatttctgcctttccgccataagcgccgacaggaagtccgcccccgattacttttcctaaacaagtcagatcaggcgttacgccgaagtagccttgagcgcagttataatcgacccggaagccagtcatcacttcatcaaaaatcagcagggagccgtactgctcagtgatatcacgcagaccctgcaggaaaccttcttgcggcggaacaacacccatatttccggcaactggctctacaatgactcccgcaatgtcttcaccgaattgctggaaagcaagctttacactgtctaaatcattgtacggaacggtgatggtgtttttcgcaatgccttcaggcacccccgggctgtcaggcagaccgagagtggcaacacctgaaccagctttaatcaagagagaatcgccgtgtccgtggtagcagccctcaaattttaaaatcttgttgcggcccgtatagccccttgccaaacggagggcactcattgtagcctctgttccggagcttaccattcggacgatttctacagatggcacacgatcaatgacgagcttagcaagttcattttctacttcagtcggagcaccgaagcttgtcccgtattcagccactgttttgaggctttctacgacgcggtcatttgtatgccctaaaattaaaggcccccatgacaagacgtagtcaatatattcattcccgtcaatatcaaagattttcgagccttttccgcgctccataaaaatcgggtccatgtctaccgatttaaatgcgcgaacgggactgttcacaccgcccggcatgagtttttgcgcttctttaaaagccgtttttgatttttcatagcttctcatctgcctcaactcctgtcaactgaataaaattactccgcaagccatttcgctgcgtctttcgcatgatacgtaataatcaggtcggcacccgcgcgcttcatgcttgtcaaaatttccaacacaatttctttttctttgatccagccgttctgcgctgcagccttcaccattgaatactctccgcttacattataagcgacgagcggcaaagtaaactcattttttacgtcacgcatgatatccatataagaaagcgaaggtttgacaatcaaaaagtccgcgccttcctcgacatctgattgtgcttcgcggagtgcctccatacggttggcagggtccatctgatatgttttgcggtctccgaattgcggtgtgctgtttgctgcatcacggaacggaccgtaaaactcacttgaatatttaacagcgtaagacatgatgggaatattgacgaatccttctttatcaagtgcttctctgatcactgtaacaaatccgtccatcatgtttgatggcgcaatgatatccgcacctgctttcgcttggctgacagctgtctgcgccaaaagttccagcgattcatcattgaggatgaccccgtctttgacaagtccgcaatggccgtggtctgtatattcgcacaggcacgtgtcagcgacaacaaccatttcagggaagtgttctttaatttctgtgatggctttttggacaattccgtgatcatggtacgcttgtgttccgcaatcatctttttcttccgggatgccgaacacgataacagattgaatgcccagtttgaccagctccgctacttcatccttcaataaatctaatgatacatggtaaacatcaggcattgacggaacagcttttttgccttccagcccttcaacgacaaaaatcggataaataaaatctgatggatgcaaacgtgtttcctttaccatttctctcattgcttttgatgtccgcaggcggcgatgtctattaaatgattgactcatattctctcttcctctcttgacatgctgcacattaattcaagcatgccatctattgtaaatgtatcaggcgtatgcgatgtgatgccgtacgtcagaagggcatcatttgttaaaggcccaatgctgatacaggccgtcccattcgccttccacttttttaattcttctcccaagacatgcataaacgtatgtacggttgatgaactcgtaaatgttacatagtcaaaggaatattgacccgcagcgtctttcagtgcctcaatgccttcttcatccggaatcgtttcgtagagaacccattcctttacttcaaaaccgagcgggacaagctcttgttttatcacatcacgtgacaaattccctttcatcacggtaatgggctcccccggttcagcatgctgcttaagagcgtcagccaattgttcagcaatatactcctgtggcatcacatcaaccgatacgttatgcgtttttaaacggcgggcggttttttcaccgacggctgcaatttttttatgcgcagggagaataagctgattttccttcagataagaaaaaaagaagtctgccccgttcacacttgtaaaaacaagccagcctggcgcggcaagatcctctcttacctgttccgcaacatcattcggcaaagcgcggcgaaacgtaatcaaagaggttaaaaccgctttaccgccaagcgcctccactttttgctgaaatgatgttgcctgtgccttattccgggtaacaagcactgtttttcctttcaacggaaaatcattttccatcctcatcaagctcccgttttacacgatcaattaaatcttttgctcctttgtcagccataagagcggcacagcgctttcctacttcctccggatcgtttccggtgacggtttctttaaaaatgattttgccgtcaggtgaagcgacaagacctgtcatttcaatttcatcctgtccatttaacacggagtagcctgcgatcggaacctggcagccgccctccatcgcgtttaaaaaagcacgttccgctaagacagtccgttttgtatattcatctgtaaactgagaaaacaacgccaacagctcttcatccgattctcggcactcaatcgccagtgctccctgccccacagcaggcaaacagcgctcaggctcaaggaattcggttacgacatcttgcttccaacccattctagaaaggccggcagccgctaaaataattgcgtcataatcctctgtttccagcttttgaagtcttgtatctatattacctctaatccatttaattgtaaggtcagggcgctcaatcaaaagctgcgcgcttcttcttaaactgcttgtgccaacgacagcaccttccttcatttctgaaagctttacgcgattctttgaaataagggcatcacgcgggtcctcccgttcaggaatacagccgatcacaagaccttcaggcaaaacagcaggcatgtccttcatgctgtgcactgccatatcaatctcttcgtttaaaagcgcctgttcaatttctttgacaaacagcccttttccacccacttttgagagtgtaacatctacaatccggtcgccctttgtcacgatctctttaatttcaaaagcaaacgaaggattgatttccttcagtttttgaataacccattttgtttgagtcatagcgagtttgctccgtctggaacctactttaatcgttctcatcatttctttcctcccgaatctgcttgggacatcgtttaactgaaccaatggaattgcgacaggcttccaagcaggaaataattgatcatcagcaccagaaaacaagccgtattccacagtgctgcgacctttccttgcagctctttaatcagcctgatataaagataatagctgtacagcagcaggacgacaaacgaaccaagcactttggcgtcaaaccaatacagcgtttctagtgagacatacgcccaaatgacgccgagaatcaaactcagcagcagcatcggaaccccaatgacatttaaaacatacgccatataatcaagcttagataaatcttctattctcaacagccattttccccactttttctttttcagcagatgatattgaaacatatatagcacagaaaaaacgaaagaaagggaaaaagcgccgtatgaaagaatcgccattgtaatatgaatcaccaaaagctcggatacaagctgcccggaaaaagcagctgactgctgctctgtcggtgaaaatgtgtgaatggcgatcatagaaaatcctataacatttgtaaaaaacacgataaagtcaacacgtaaaagctttgtcagtacaagtgacagcgtgacaagcacccaggcataaaaataaagcgcctccgtcacatttaataccggaaaccgccccgtcacccacataaaataggccaaatacacggtttgcagagtccagacaatagaaagcaaccagaaggccatttttccagccttccggttgtgttgaagaaaatctataaaataaaagagtacacttaacgcgtaaatgacgattgtcccctcattaagtcttgccattgcagtatcaatcattcagctttcactcacttacaagtgggctaaagcccgcttttgattcagccttcttaaaagagtggaccttctggctgctttccacggttttcatcatttgacggcccgcagcttcttcaatatcaaaaatctgcataaacaacgcgagcttttcttcagaatcagcatctgccgcaagctctttcacctttaaaatcggatcacgaagcatttggttaataatacttttggtgtgtttgttcaacagttttttctctcttgtgcttaagtgaggcagcttacgctcaatgctgtccatcgtttctgactggatagcaagcgccttttcgcgcaatgcagaaataaccggcacaacaccaagtgtattcatccattgtttaaattccacaatggtttcttcaattaacagttcaactttttcagctgtttctctccgctctttcatgttcgcttctacaatgccttccagatcgtcgatatcataaagaaaaacaccttcaagatcattcagcgccggatcaagatctctaggcacggcaatgtcgaccataaacagcggacgtcccttgcgaagcttattcgcgttttccatcatctctttggacacgacaaattcacttgcaccggttgaactgattaaaatatcagcctccgcaagcgcgctttcaagctgattcaagcttctcgcttcacctgagaaacggtctgcaagctccttcgctttcaagtatgttcggttaatgacagtgaccttgccgattccctgtccgtgcaggttttccgcagcaagctcgcccatttttcccgcaccgagaatcaatatgtgcttgcttgaaagatttccgaagatttttttagcaagttcaactgcagcatagcttactgacaccgcatttgagccaatgtctgtttcggcgtgagtccgtttgcccactgtaaccgcctgcttaaacagctcattaaaaatagtcccgatcgttttttcttgctgagctgttttaaagctgtcgcgtacctgtccgagaatctgcgtttcgccaatcaccatagaatcaagtccgcaggctacacggaataaatgctcaacagcggcatcgctctcataaaacgttaagaacggtgacagctcttctttgcttaattgaaaccaatcagctaaaaacttttttatataataacggccggtatggagctggtcgactaccgcataaatttcagtgcggttgcaggttgagacaatgatgttttcaagaatgcttttctcttctttcagctgcaccattgcttctgccagctcattcggctgaaaacttactttttcacgtatctcaataggggcggatttataatctactcccacaacaagtatatgcatcgctctaattacacccccaacgcccaatcttaatttataatcattctaacatagaactcattatttataataattataacatagtttctttcacaaaatgtgaacagattttaaaattcttatgctatattagaaaaagcttcagggaaaagaagcattcctattgacaataccaaaaacagcagaaatttactacacatcagctctaaaaaacaagaaggtgatatgcatgaaacaaaaatcaattttattcccttgcctgctgcttgccgcttctgtatatgcatggcttgaaagcggccaagctgaactgttttcgggacaggatcaatggcctgttctcctcatgctgttaggagcagcctttgtatatcaaggaaaaaaagaagccgttgcaccccatttctttatcggtttgcttctcttcgggatcggtttacacttttttgccaagccgaaatgggtatggtggccggatgattttgaaatgcttctctttatgatcggcttctcactactcgtttcaaccgttcaaaaaaaagaatatgtatatgaagctgtgtcgatgatttgtttttccctgtttttgtactttttcaaacaaattatggcatggcttgagtctgcgcatattccaacagcgcttctgaaggagtattggccgtttgtctttattggaatcagtttattgttattattgataaaacgaaaaaaatctatacgataaataaaaccggtagaggatcctctaccggtttatcatttttttgatcgctccccaagcttcgtcttttccctttttcgtttctgaggaaaagagaatcagctcgtcttccggatcaatatttaatgtttgtcggacaaccttcgcgtgtttgtcccatttgcctttcgggatcttatccgcctttgtagcgataacaataacaggaatgccgtaatactttaagaattcatacatctgtacatcatcattagatggcgcatgccgcaaatcaacgatctgcaccacagcttttaattcctcgcgtgtcgtgatataggtttcaatcattctcccccatgcttcacgctcagactttgacactttggcaaaaccgtagcccggcacatccacaaaatgcaactcatcattgataatgtagaaattaagtgtttgtgtttttcccggctttgatgacgttctcgcaagatttttgcgattgattaatgaattgataaaagacgattttcctacgttcgatcttccggccaatgcgatttccggaagccccccttcagggtactgttccggttttactgcactgatcacgatttctgactttgtgactttcatttcttctctcctactaaggcatgttccaaaacctcgtctaagtgggacgccaatataaatgtcagcccctccctgacgctttccggaatatcctctatatctttttcattatctttaggcgcaataatggtcgttaatcccgctctatgtgcgccaagcgctttttcctttaagccgccgatcggcagcacgcgcccgcgaagcgtgatttccccagtcatgccgacttcacgcgaaaccgcccgtcccgttaaagcagaaacaagcgctgttgccatcgtaataccggctgacggaccatcttttggcaccgcaccctctggtacatgtatatgaatatcatacttctcatgaaagtcaggttcaatgccaagttcttctgttttggatcgcacatagctgaatgcagcctgagcagactctctcataacatctccgagctttcctgtcaggattaatttccctttccccggagaaagcgatacttcaatcgacagcgtatctccgccaacggttgtataagcaagccctgtcactacaccaacctgatcctctgtctcagcttgtccatatctgaaaatacgttttccgataaagtcttgaaggttcttctcagtaaccgtaatccgttttcgctcttcagcaacaatggcttttgcagctttacggcaaatcgcggcaagctggcgttcaaggcttctcacaccagcttctctcgtatagtagcggataatatcaagaatcgcctgatcacgcagctgcaggttgcttttcttcagcccgtgttctttgatttgctttggaagcaagtgatcctttacgatttcaagtttttctatttctgtgtagcctgcgatattaataatttccattctgtctctgagcgggcccgggattgtggccaaattgttcgccgttgcgataaacagcactttggataaatcaaaggtttcttcaatatagtgatcactgaagctgctgttttgctctggatcaagcacttcaagcatagcggatgatgggtctcctctaaaatcagatgacattttgtcaatttcgtctaataagaagaccggattcagcttgcccgcttttttcatcccttgaataatacgtccaggcattgctccgacataggtccgtctgtgtccgcgtatctctgattcatcccgtactcctccgagtgagattctgacgaatttgcgtcccaagctttttgcaattgatttggctaaagacgtttttccgacacctggaggtcctgccaaacagagaatcgggcctttcagggatttggtcagcttctggacagccaaatattctaaaatacgttcttttactttttcaagcccgtggtgctcttcgtccaagagacgtcctgcttctttcaaatcaagcttatcatctgtttcatccgtccacggaagagcaaccagccagtcgatatagttgcggatcacagagctttccgcagaacttgacggaattttttcatatctgttcaattctttaagcgctgtttctttcacatgatcaggcatgcctgcttcttcgattttttccgtcagcgtctgaacttcgccagttttgccttctttatcgccaagctctttttggatcgccttcatttgttcacgcaagtagtattccttctgcgtacgctccatcgaacgtttgacgcgctgaccgatttttttctcaatctccagcacttctttttcattattaataaaatcaatgaccttgttcagcctgtctttgacatcagccgtttctaaaatatcctgcttatcctttagtttaaggggcagatgagaagcaacgatgtctgccattctccccggctcttcgatatcagtaaccgcagcgtacgtttcggccgagatttttttagaaatttttatgtactgatcaaagtggtctagcaaagtccgcatcaatgcttcgtcttctgtatcttttgaatcatcttcatgaataagttgaatgtcaaccgacgtgtaatcctcgtgttcattgtatttgacgatatgggcgcgcttgaggccctccaccaacacacgaatcgtaccgttcggaagcttcagcatttgcttaatttttgtataggtgccgacagtgaaaatctcgtcttcaccaggttcgtctatcgaaatatcctgctgagtggctaaaaatatcatatgatcatgcatcattgcctgttcaagagcctgaaccgacttgtcacgtcctacatctaaatgcaaaaccatcgtcgggtacactaataaacctcttaaagggaggagcgggatgctgcgttttaattcttctgccatgtgactgacacctccgtgactttagtatgaaccattataatacaactttttcatccttgtacaataaacggcatggttccattttctataaaacagtctcctcgtagtataccctttctttctgatatgaaaaaggaaaagatgtccttcatgaaaaaaaccctattatcaaaatagggtttaaacggattctttattgatttcgatatgaaacggtttttgttccgttggcggattcaccaaaatttcatcaagcacttcttggaacgtcttcactgcaataatctcgatcccgtcaatctgctttaagatggcctgctgattttcatatgggataatcacctttttcgcaccggactgcttggccgcttttattttcggaatgacgcctccgatgggtttcacaagaccgttcaggctgatttcgcccgtcatcgcaacggtattgtcaataggaattttgtgtatcgccgagaaaatccccgccgccatcgcaatgcctgctgacggcccatcaatcggaatccctcctgggaaattgatgtgaatatcataatcagaaggcttcattcccattgtccggagcacggttaatacattttcaaccgaacccttcgccatgctttttcgcctgatcgattttgattggctgccgatgctttcttcttcagctattcctgtgatgttaattgatcctttatcttgagccgcggttacacttacttcgatttccagaagcgatccgctgttaggcccatagactgcaagcccatttacaatgccaacctgtggttcaacaccgattttttgctcgtgctttggagtaagctgactggagtgaatgacccattcaatatcctcaatcgtaatgtcctttcgattctccgttacagccatccccgctgcgatttgaatcatattgacggcttcccgcccgttccgcgtgtagctggtcaaaagatccagtccttcttcggagataattttttcaattttatccgctgctgttttggcaaccgttttcaactcgtccttttcaagctcgcggaaaaaaacctccaaacagcgggaccggatagctggcggaatttcgtttggcattctcgtggtcgcgccaatcaagcgaaaatcagccggcagcccattttgaaaaatatcatgaatatgattcggaatttgtgtattttcctcactgtaatacgcactatctaaaaagacttttctgtcctcaagcaccttcagcattttattcatttgaataggatgcagctcccctatttcatcaataaacagcacaccgccatgggcatgggtgacagctccctgcttcggctgcggaatcccagcctgtcccatcgctccggccccttggtatatcgggtcatggacagagccgatgagtggatcggcaattcctctttcatcaaaacgggctgttgtcgcatcgagttccacaaagacagcctgctctttaaacggtgattgtttatgtttttttgcttcttccaacacaagccgcgcagcagccgttttcccaactcccggtggcccatagacaatcacatgctgaggatttggcccgcataaagccgcctttaatgctttaatgccgtcttcctgtccgacgatatctttaaagcttttggggcggaccttctcagataatggctcggacaagctgatagcgcgcattttccgaagctgctccatttccttctttgattctttatctatcgtgaccttttgtgtcctttgatttttaagcaaattccaaaaatacaaaccgatgatgatcccaaaaaacagctgaataaataacgcgatccctgtccaactcatggtggtccctcctgaaaaacaatttatgtatccaattcattcctctgattgctagtatctcccatagaagacgggaataaacgtttttccggaagagttgcatgcaaaaaaacctcctgagtgttaccactcaggaggtttgtgcttatctttatgcagatgttttatcttggcttacctcagtgccgtcttttaataagaggcgaggaggctctccgtgtgtcacagttgccccggtgattacacatttttcaatgtcatcacgagaaggcagctcaaacatcacatcaagcatgatgccttcaatgatggaacggagtccgcgtgctccagtcttgcgttcaattgcttttttagcaatttcagaaagcgcttcttcttcaaactcaagctcaacgttgtcaagctcaagcattttcttgaattgcttaactagagcgtttttcggttttgttaagatcgcaaccaatgcttcttcgtcaagcttttcaaggcttgcaataaccggaagacgtccgataaattcaggaattaacccgaaacggagcaaatcttcaggaagcacttttgaaagaagatcttctttctcaagatcagcagctttattgtcggcaccgaatccaatcactttttggcctaaacggcgtttgatgatttgttcgataccatcgaaagctccgccgcaaatgaacaaaatatttgttgtgtcaatttgaatgaattcttgatgaggatgcttacgtcccccttgaggcggcacgcttgccactgtaccctcaagaattttaagcaatgcctgctgtacaccctcacctgacacatcacgtgtgatagacgggttttcagattttctagccactttatcgatttcatcaatatagataatgcctttttcggctttttccacatcataatcagcagcttggatgagcttcaagagaatattctctacatcttcacccacgtatccagcttcagtcaaagatgtagcgtctgcaattgcaaacggcacatttaaaatgcgagccaatgtttgcgccagaagggttttaccgcttcccgtagggccgattaatgaaatattactttttgagagctcaacatcatcaactttgctgttagagttaatgcgcttatagtggttatacacagcaacagcaagtgatttcttcgcttgatcttggccgatgacatattcattcaaaatttcgcgaatttcctgaggctttggtacgtctttaaattctacttcttcttctgttccgagttcttcctctacaatttcagtgcagagttcgatacattcgtcacatatatatacaccaggtccagctacaagcttacgaacctgatcttgtgtttttccacagaacgagcattttaattgtcctttttcctcgttaaatttaaacattctttcaccccttaatcttgtctcactttttcttttaccggcagagcaaaagaaaatgattcttgaaacgaacgagtatgtattgcattttaccatactttccaaaaagacggtaacaatgtgtttctgacttgcacattctatatgtatgacaaaaaacagccctgcattaactatattgccccaagaaaaagagataactcataattgtacaaaacaaggcacgaatgattcgcgccctgttttattagtactattattatgcaccatattaacggttttctacaagaaaatcaattgctttgcgaacttttaaatcttctttcatcgcgtcagtagaaccgatggcttgtttaatattttcaacaggcatgttgtatgcttcagccattttagtaagctcagcatcaacttcctcatctgatacttcaaggttttccgctttcgcaatcgcctcaagagtcaggttagattttacgcgtttttcagcatcttctttcatttgctctttaagcgcagcttcatcttggcctgagaattgagtgtaaagctcaaggttcatgccttgcatttgcagacgctgttcgaattctttcagcatgcggtcaagctcagtgtcgaccattgcttgcggaacatcgatttcagcattttcagaagctttcagaacaagctcttcacgcaatttagcgtcagcttcgttttcttttgcttcttctaaacgtttctttgttttttcagttaattcagcaagtgtttccacttcttcatcgatatcttttgcgaattcatcgtcaagctcaggaagctctttcgctttgatttcgtgaattttcactttaaacacagctggtttgcctgcaagatcttcagcgtggtactcctcagggaatgtcacttcaacatccttctcagcacctgcttcaaggccaactaattgatcttcgaagccagggatgaatgagccagaacctacttctagagagtagttttcagcttttccgccttcgaaagcttcgccgtcaacgaatccttcgaaatcaagaacaactgtgtttccttcttcaacagcgccttcttcttttacaacaagctcagcttgacgctcttgaagggcttttagttcgttttgaacatcttcgtcagttacagttgtgtcgtctttttcaatgcccaggcctttgtattcgccaagcttcacttcaggttttactgttactttcgcagtgaagattaagctttcgcctttttcgattttttcaacatcgatttcaggacggtctacaggctcgattccagcttcttcaaccgctttagggtattctacaggaagaagaatatccaaagcatcttggtaaagagcttctacgccaaagcgctgttcgaataatccgcgaggaattttacctttacggaatccaggaattgaaacttgttttactacttttttaaatgcatcatcaagtgctgttttaaacgtttcagcatcaacttcaaccgttaaaacgccttcgttgccttcttgtttttcccattttacagacatgtgtttccctccaaaaatctattcaggttgtgtcggtcttccattctaaagcaatcattcggcttcgtccaacaaaaacaaagctgccaaagatcagaatcattatgtatagatgttaataatgaactgcaaagcctgtccaaccgtatttcttataacccgttatacacaaatacaaccactatattataacataacacatagcgctttcaactatatggcgcgatttacaaataagaaatttcttcaatatcttttaacattgtgcaagcttcatcgagttctctgtcggtaaattcatacatcatatgaagttcttctctttcaatttcaattccgtgcatctcgtaaccgactttatgcagggcagccgcccaaaggtcagccgacagcaatttcggctggaacggatataaaacgtacaaatgtcttctccacaattcttctactgccgcgtataaggttggattttcatttccaagtgtttcatccagcaccctgagaacacggtgcagaatcggcgcggcatcaggcggaacaatctcagacggttcaattgtcaacgactcgccaaatttactaatgtgtacaggtttactgtactcatgctcagctaacagcatgacaatcatcgttttgataatcggatgggctgaggggtcttggaggattgttttgagcaatcctgtatactttgctacgttacggtcttttaaggaatggatgagattcatttgctcctcagggcttgccagcactttctcggtgtcaattgtatcctcatattcttcggcccaagcctcgtcctcacgatctggatcggtcattttccggctgaaatccagcagcttataaaattgctcggcgctttctgccggcagctgattttcttccaaaacggcttcaatggtgcttttgacttcttcgtattttttgagctgaattaagatggtcatgtacacctgcaaaaccgtaaaataatggccataaccttctttgagcatcttctcgcacacgctttctgcctcttccagctcgcccagctctaaaaagcagatggccatccctaagtgaagatcggattcagtatcatcatatttcatcgcttctgaaaacagttcaagcgcttcttgatactttttttccttgagtgatgacatccctttttccacaaggcggtctttcagatgaggaaaaggaataatttttgcgtttttcttgtcatgcgtcatacctatattcctttcaggcatttattttgttcaagtgtatcaacacctgtgaacaaacacaagaaatgaaaggtttcaccaggcaaaaaaagccgccggacaaataccggccgctttttcagtcttgaagccaagagcttctttgtgattcaaattgcttgatttcatcttccagcagcagcgttaatgaaatttcatcatatccgttgatcagcatctctttccaatgcgggtcaacttcaaatgaaatttgattgccttcactgtcatgaatcagctgattttcaaggtcaacagtcatttgcaatgacttgttttcatactggccgacaagctgtttccaattgtcatatggcatgcggatcggaagcatgccgtttttaaagcagttctgatgaaaaatatcagcaaatgacggcgcaatgataattttaaacccataatcatcaagtgcccacggagcgtgttcacgcgatgacccgcagccgaagttttctcctgctattaaaatggaagctccttgataaacaggctggtttaattcaaattcagggttcggttcaccattcgcatcatatctccagtcaaagaatgcaaaacgcccgtagcctgttctttcaatcctcttcaaaaattgcttaggaataatctggtctgtatccacattgatccgatttaatacggctgctttccccgtatgtgatttcaaaggttccatctcgcgcactccttacacaactgttttttcctgataaaactttctgacatcaacgaagtgtccgtgaatggcagccatcgcagccattgccgggctgacgagatgtgttcttgcaccttttccttgtctgccctcgaagttgcggttagaggttgatgcacagcgctctccctcaggaacaacatcattattcatactcaaacacatgctgcagcctgactctctccattcaaatccagcttccaagaaaatctggtcaagcccttctttttcagcctgaagcttcacgctttgagatccgggcacgacgatggcccttacgctgtcagctaccttcttccctttgatcatatcagcagcctgtcgaaggtcagtcatgcgggaattcgtgcaggaaccgataaatacgtgctccactttaatgtcttcaattttttggtgaggagtcagtcccatatattcataagcgcgaatcgcttcttttttatcatcttctgcagaaaagctttccggcgcaggaacttcagaatcgacaggaagaaccattcccgggttaatgccccatgtcaccataggggaaattttgttgccgtcaaggaagatagatttatcataaacagcgcccgggtctgtgcgcagcgccctccattcctctacggccttgtcaaattcttcgccttttggcgtgtacttgcggtttttgcaatattcaaacgtcacctcgtcaggtgcaatcaaacctgctcttgctcctgcttcaattgacatgttacaaacagtcattcgttcatccatcgtcatatttctgaatacttccccagtgtattcaatgacgtagcctgtgccgaatttcacaccgtatttgccgatgacagaaaggatgacatcctttgccgttacccctttttgaagcgttccatctacgcgcacttcaagtgtttttggacgctgctgccaaagtgtctgtgtggaaaggacatgttcaacttcactcgtcccgattccaaatgcaagagcgccgaaagcgccatgtgttgatgtatgactgtcaccgcacacaatcgttttccctggaagcgttaagcccagttcagggccgacgacatggacaatcccttgatccacactgtgaagatcggcaaggcgcacgccaaattcctcacagtttctttcaagcgccgttacttggcgtttcgcaacttcatcctttatctcaaaacgattgacagtcgggatgttgtggtccattgtcgcaaatgtattttggggtcttctgacctttcttcccttttgtctcaaaccttcaaatgcctgaggagacgtcacctcatgaatgaggtgcaaatcaatatagagaagatccggctttccctcaccatgttttacaatatgctgatcccaaatcttttcgatgattgttcgaggcatcatcttttatttcctccctctacctagagctaagaccgcttaacgtaagctgtcacacattagaaattgtattttcactcatgattgctgccttaacttcctctgtaatggcctgagtgctgctgaactcttcaccccgtgccaaatcttttgttcttttcccagaagccaagactttgtttaccgcatcttctacagctttcgcttcctcttcaagcccgaaagatgttctcaaaagcattgccgctgacaatatggctgcgaacggatttgccatccctttaccggcaatatcaggcgcggagccatgaacaggttcaaacagatgaagaccagagcttgataggctggctgacgggagcattccgagcgagcctgtaagcatggacgcttcatcgcttaaaatatcaccgaacatattttcagtcaccacgacatcaaattgattcggtgcataaattagctgcatggccgcgttatccacaagcatgtgctcaagcttcacatcaggaaactcttgtgcaacgtcctcagccacttcacgccacagccggcttgattcaagaacattcgctttatctacagaggtcactttgccttttctggctgccgccattttgaagccctctctgatcactcgttcaatttccgttctcttataaaacagtgtatctactgcttcctgctcaccttcagtgtttacataacgtttgctcggctggccgaaatacaagccgcctgtgagctcacgaacgataacgaaatcaacattatctatatattcttttttcaaaggcgaagcgtcagaaaggctttcaaataccttcacaggccgcaaattcgcaaacaaatcaagctgttttctgatgctgagcagccctttttccggtctcagttccgaaggattttgatcccatttcggtccgccgacagcgccaagcaatatcgcgtctgcatttttacaagcagcaacggtttcctccgggagggggttatgatgttcatcaatagccgcccctccaatcaggccatattcaaattcaaattcatggttaaagcgttcggcaacacttttcagtacgtctgtcgctgattctaatacttcagggccgatcccgtctccgggcaatagagcaatacgtttcttcaagttaaccgttctcctttcttttatgatccgacagctgtgtggtttttcaatccgctcatattcgactggaaaaccaattgacggttgactgcgttcaaataggctttcgctgatgcttctaatacgtcttgcgctatgccccgacctgctgattcttttccgttcaccaaaactcttacatacacctgggcaaatgcatcttcgccttttctgttagactgaatgcggtagtctaagagctccacgtccttatcgatgcagcgctcaagcgtattgtagattgcttccacacttccagctccagttgcagcttcctgaataagctctgcgttttcttgatttttcaacgaaagagtagccgtagggacctgacttgttccgtaatgtacttgcagagaaagaaattcatacccaatcttgcgatctgttactttttcttctaaaataagagaaacaagatcctcatcagtgatttcttttttcttctcagtcaactctttgaacatcgtaaagaatttattaatctcttcactgtcaaattggaatcctaaagcagtcagccggtctttaaatgcgtggcgtccggaatgtttacctaggacaagcgcatctgcggttacgccgacaagctccggtgaaataatttcataagtcgatttttcctttaaaaagccgtcctgatggatgcctgattcatgagcaaatgcattatctccaacaaccgctttgttgcgcgggacagccatgcctgtcagtttgcttactaaatcacttgttctcttaatctcgttcagtgtaatacctgtttcgacttggtagaaatcttttctggtatgaagggctacagcaatttcctctaatgccgcgtttccggctctttcaccgatcccgttcacagcgcattcgatttgatcagcgccattttcaatcgcagcaagagagtttgcgactgccattcccaaatcatcatgacagtgggctgaaagctttgctttgtgaatgttcggaacgttttctttcatatatttaaagatatttccgtattccgccggggccaggtagccgacagtgtccggaagattgataacactggcgcctgcgtcaatcactttttcgacgatttctgctagaaacggcagttcagtgcggcaggcatcttcagctgaccattgcacaatcggaaaacgttcttttgcgtatttcaccatttcaaccgctctttcaatgacttgctcacgtgtcattttcagcttgtgcttcaaatgaatgtccgatgtggcgataaaaacatgaattctcgggtgagaaccttcttttaacgcttcccaagcagcatcaatatcaccttttacacaacgggccagaccagttactgaacaatttttaatggttcttgcgatttcctgaacagctaaaaagtcacctcgggacgaagcgggaaatcccgcttcaatgatatctgccccgagtctttcgagctgcttagctatggcaagtttctcctgtgtattcaagttcactccaggggactgttcaccatcacgaagcgtcgtatcgaaaaaattaattttgcgcaacggagaccaccgcttccttcttcttgccttgtttcacaaacggcatcatttcacgaagctttcttcccactacttcgatttgatgttcgttctcgcttgcattgatagcattgaaacgaggacggtttacttggttttcgacgatccactcttttgcgaatgtaccgttttggatatcttttaatacttctttcatagattcttttactttagcgtccacaacgcgaggacctgatacgaaatctccccactgtgctgtgtcagagattgaatatctcattcctgcaagtccttcttcgtacataaggtctacgattaatttcagctcatgaaggcactcgaagtatgcaagttcaggctgataacctgcttcagttaatgtttcaaatccggctttgacaagcgcgcttaatccgccgcaaagaactgcttgctcaccgaacaaatctgtttctgtttcttctttaaatgtcgtttctaatacgcccgctcttgcgccgccgattcctttagcataagcgagggctttgtctcttgcttctccagtcacatcttgatagattgcgaacaatgccggtacgccagctccttgctcatatgttcttcttaccaagtgtcccgggcctttaggggccactaagaatacatctacatccgccggaggaacaatttgatggaaatgcacgttaaatccatgagcaaatactaatgattttcctgctgtcaattcatctttgatttcagcttcgtatactttttgctgttgctcatccggaagcagaaccatgatgatttcggcttgggctgccgcttcttttactgaaaatactttatgtccgtcttcttgggcttgagtgaaagattttccttgtctaacaccgacgatcacgtctactccgctttctttaaggttcagggcatgtgcgtggccttgcgaaccgtacccgataaccgctactgtttttccagccaatacgttctctttgatatcaccgttataatatacttttaccattttaatctctcccttgttatgttttatacaatagatattgttttattggatgacgccttttgctgggttcccctcgcaaaagccgttgtacctgttctcgcgatttctttaatgccataaggttttaataactcaataagcgcttcaattttgttagattcacccgtcacctgaacaacgatgctgtctctgctgacatcaacgacagaggctctaaacggttctatgattccattaatctctgttctcgttgaaggtgcggagacaaccttgattaaggccagctccctctggacaatcgattgatttgtgatgtccgtgactttcagcacatcaatctgtttgttgagctgtttcgttaactgttcaacatcattttctccttcaacgtgaacgacgaaggtgattctggaaacgccggctgtttctgtgtgcccaactgtaatgctttcaatgttgtaatgcctttttgtgaatagaccggtgatccggtttaacaccccggagcggttcaccacagtcaatgtgataattcttttcaaggtttcacccccaccatttcatgcagccctttccccggagccaccatcgggaatactttttcttcgctggcaacccgcacatcaatgacaacaggttctcttgatgttaatgcctcttccagcttttcctttgcttccgcttctgatgaaattctgatgcctttaatgccgtatgcttcggacaatttgacgaagtcaggctgagaagcgaatttagattctgaataacgttcttcatagaaaatttcctgccactgtctgaccattccgagacaagcgttatttaaaatcactaccttgaccggaagatttaattcgcgaataacatcgagttcttggagcgtcatttggaatccgccgtctccgacaaccgcgacaacagtagcatctttttcggccagctgtgcgccgatcgccgccggaagaccgaatcccatcgttccaagtccgcctgacgtgacccatttatctgctttttggaacggataaaattgcgctgaccacatttgatgctggcctacatctgttgcgacaatggcctctccttttgtaaattgatgaatatattcaatcaatttctgaggtttaaaaccttcttcttcattatctacataccagagcggatactcttctttccattcagcgagctgttttttccattcgcttgaatcgctttgtttgccgtcttgtttgatcagctcctgcaggacaattttgctgtctccgactacaggaatctgtgttttcatgatttttccgatttcagctggatcaatatcgatgtgggctatctttgcgtttctggcaaagtgtttcaggtttcctgtgacacggtcatcaaaacgggcgccgatactgattaatagatcacattcatgaagggccatattggctgtataagtaccgtgcattcccgccatccctagaaaaagcggatggtcagccgggaagcctccgagccccaaaagggtgtgtgccacagggatttgctgctgttcggcataattttttaattcttctgacgcttttccgtgcagtacgcccgcacccgccaggatcaccggttttttcgcactgctcacggcttccacaagcttgcggatctgcaaataattcggctctgttgtcggctggtatcccgggagattcatctcatgatcgtagctgaattctccttcaattgttgctacatctttcggaatatcaatcaatacaggtccgggtcttccagttgttgcaatatggaacgcttctttaatgatgcgcggcagatcttccggctggcgaacctggtagctgtgttttgttactggcatcgtaatccctaaaatgtctgcttcctgaaatgcatcgctcccgattacagaggttgctacctgccctgtaaagacgactaacggcaatgaatcaatcatggcatcagcaaggcctgtaacaaggtttgtcgctcccggccctgacgtggcaatgacgacacccggttttccggagacccttgcgtatccctccgctgcatgaattgctccttgttcgtgacggggaaggatatgtaccaaccctgaattgtatagcttatcgtaaatcggaagcacagccccgcccggataaccgaagatcatttctactttctctttttttaatgattcaatcagcattaatgctccgctcatcgtctgtgtacattcggcagatgctgaatccacctgtacattagtccccattttagttcctccttttggattttcatcctttaaagatcatcttttcattagctatatagctgattattcaataaaaaaagcccttccgcccacaatcagccgcgcagtaactgcgatagctaaaaggggcgaaaaggcttttctttccgcggtaccacccttgtttacggcctgttaatcggccgtctcatggatatttctatccgctttagtaacgagtgaatcaagttcacccggccaagtcctactgtcatttcagactggcactctgaggcgagttcaccttgtaaagcttcgccggttctcagctaacccggttctctgtggaaagctttttcaaggctacttatcctcatctgcgcttttcatattcagccttcggaacggttttccagctgttcaagaaggtcgtttgtttttcactttttagaatcatactgcgatgattttcgcttgtgaagcttgcgtttatcttttgttgaactcatattacgccgctttggacgcagtgtcaacagcattttttaaaattattagacaattttgattaatcaatctatattgtatacgctttcattattggtacaaaaggaattgcaaatgttaaaagtttttataatttttttattaatctatcaagaataaaccagaattatttaattttatataaacatgtaagattttataacacgctatggttcgtatatggattgagtctgacagatcatcttgcaatccatttcaatttcggataggcacccctattattcctcggcatacattaatggtatcttgcaaagaaaaggtgatacgatgaataaatcatttgcagacatgcaaggatttcctgcgggctttccaagcttccccaactttccgcagcagtattatcctgctacccctgccttctaccagcaaagccagcagccatttggaggctacggatacggacagccgttcagtcaggcatacagcccgttaaccactccctctggaatgtactcctcattcccatacgcttcagggttttacggacagcaattttcaggtgcaggctttagcggccatggcggcagcttaagtgctccagcgatacatgccggcggattcagcggggcgccaggcgtacacggaggctttagatattaaagaagaccacaagggccgaacatctattgcggtccttttattgttttaaaacgacttcacaaatacagtcacattttctgtctttatatttggaaacaggatggaatatgattagatgaattgaacgatattctgcacaatccgtaagttttcgaggaggaataaaattgcatataaaaatagacgatttaactggacgtcaggtggtttcactggtgaatgagcatttacatagcatgacgcttatgtccccgccagaaagcattcatgccttaggtttagaaaaactaagagggcctgaaataacattttggagcgcatgggaaggtgatgaactagctggctgcggagcgctaaaagaactggacacccggcatggagaaatcaaatcaatgcgaacatctgcatcacatttaagaaaaggcgttgccaaacaagttctccagcacatcattgaagaagccgagaagcgaggctatgagcggttaagcttagaaacgggttcaatggcttcatttgagccggcaagaaaattgtatgaaagcttcgtttttcagtactgtgaaccgtttgcagactacagtgaagatccaaacagtgtgtttatgactaaggaaatgtgagacgattttataaggatagataagtgcaggggaaggtctgtcttatctatctttttttatattcacacatttttcacctttatgatacacgccaatgttttcaattttgtttaattcaaagaacagcgggaattacaaacgacatgaacgatatcatgcaaattcataaaggaggagattgatatgaaaagcatagttggtgtatatgaaactccgcaggaaaccatcgcagcgattgaaggcttactcacaaaaggctatgattctgatgacatttctgttgtgacaagccggcgagatacagattatttggagtcacgtacaggaacagaagtcaatcaagccatcgatgcacatcaggacgaatctgaatcttttttcgataaactgaaagattatttcacaatggatgatacttctacacacagcaaagcattatccgacttggatattaaaactgatgaaatagacaagtatcaagaagatttggatgacggaaaacttctggtagccgtcgatacagatgcaaatgtaaatgctcctattgataacggcaatgccctttcaggcggcttttcaagcacaaatgaattggattatacaacgaaagaagaaaaaacgatgccgctccgggaagaacagctgaaggtcgataaggaagacgttcaaaccggcgaagtagaaataggaaaagaagtgaaaacagaaaaaagagatatggacattccggtgagacatgatgaaatttatgtcgaacgccgtccagtggatgaaaataaaacggacgctgctcccgtcaacgattcggaagagatcagagttccaatcgttgaggaaaagctggaagtgactaaaaaaccggttgtcactgatgaagtggttgtcggcaaacgcactgttgaagaaaatgaacatatttctgaaactgtgaaaaaagaagaacctcgtctgaataaagaaggaaaagttgacggcttggatgatgatccgttaaataacaaatgaaaatcataagacgacaacaaaaacctcaaatccatttaggatttgaggtttttcttttggtacgtcccaggagagattcgaactcccgaccgacggcttagaaggccgttgctctatccagctgagctactgggacacgttttgtttttcgctttaactatcagcgacaagatttattatatatgggatgcaataataagtcaacggttttttagaatttttttcatgaggaagaaaattttcttcctcatgacattttcatagtgtgactcggttttgcagatcctcaatttcattgcctgcttggtcgtaaaaacggactgtcgcagcatcattttctaatgtcagtatagcatagctttctgtcctgcgcaccctcggaagccggatgctacctgggttaatcatcagttttccgcgcagcacttcgcttcccgcgatgtgcgaatgcccgaagcagataacatccgctccgagctcctctgcacgatagtatacgtttaacaaggtctgttttataccgtgaaggtggccgtgtgtgaccagtatttttcttgagccggcattcagaagaagctcgtccttaaaatcgccggcaaaatcgcaattgccttttacaaccgcataaggctccaatgcaggatgcctcgtttcaagctcagagtccccgcaatgaatcatgagatcaacttctgcctcatgccgtttcgcaatggtttggagttcttcttcaagcccatggctgtcactgataatcagcacgttcatgtacaagcttcctccttatgcctccaaaagcttagacagctttttaagcgcgtcagccctatggctgattttatttttttcatcacttgtcagttcagccattgtcttatctttatctttcacgataaagattgggtcatagccaaagccatattctcctctcggttcttcggcaatatacccttcaacatggccttcgactgtttttgtttcctctccgggaatactcacggccagtgcgcagcggaaacgggcggtgcgctgttctttttcgatacctttcagctcgctgagcactttttcgatatttgcctggtcgtctttctgttcccctgcatagcgggctgaataaaccccgggtctgccgccaagattatcgatggatagaccggagtcgtccgcaatcaccattttgttcactgctttggcaacagcttccgctttcagaatggcattttcttcaaatgtatggcctgtttcttcaatttcttctgtgaatccaatttcagctaaagatttgacatcatagcctcttggctcaagaatttctttgaattccttcacttttcccggattatgtgtcgcaataattgcttctttcatgatgatcaagcctttctgtctttatttcagttctggcagagaatcacccagcacttctttttgcttgtcaatcagctcttgaattcctttttccgcaagacccagaagaccgttcagatcctctcttgaaaaagtcgcctcttccccggttccctgcagttccacaaaacggccgctgcctgtcatgatgacattcatgtcaacttcagccgaggaatcttcttcataatttaaatctaacaaaattccctgttccttatcaattccaacagagattgcagcaagaaaatcagtgatcggatttgtcttgattgttcctgctttgatcagcttgccaatcgcaatcgccatagcaagaaatgcgcctgtaatggaagctgttctagttcctccatcagcttgaataacatcacagtcaatccaaatcgtccgttcaccgagcttttccagatctacaacagctcgaagcgcgcggccgatcaggcgttggatctccattgttctgccggaaattttccccttagaagattctctgattgttctttggtttgttgcccgcggcagcatgctgtactctgctgtaatccagcctttccctccgccccgcaaaaacggcggtacgcggtcctcaacagacgcgttgcagattacctttgtattccctgctgttattagaacagaaccttccggatggctgataaaatccaaatcgaatgtgattggacgcagctcatcgtgttgtcttccgtcatgtctcatgttttacctccgattgtatgtacataaaccatttttgtcccggaattgaataaagaaagaggcagccggaacgctaacctctttctttctagtatatcaaaaatcccaatttaaaaactacccgtattcacttgagatggtctggagaccggttctgtgagcttttcgcctttttcatttacaagctctgattttccgttcactttaacagagacgctttttacatccggctgctccgttaacgtcagcacaatgctgttcagcacttctgaagaaatcattttcgtcttctcatcggcgctgccgaatatagattgattgaaatccaacgtcacgcgcccgtctttgattttcggtttgctgaccagctttacatcttcactgaagtctgttaacagcccgctcaccttgcttggccctttagccaattcattgatggctgccgtgatgtcgtctttttccgaattgtcgattcgtttggtcaccggcacgtagtattcactgtcttcgttttccgccaagtagtagactgtcagcggatgggtagcagtgagatcatttacaccggctgtttccaaattaatgccgtctttgcggcttaaatcatctgagatcggcgtccctcctacaggcatctccttcagttcatgcccgtttattctcagcttcactttatctatcgaactaaattgcgtcagtgtccacgtcacagattgaacgattttctgttcgtcttctttcttataatttttgaactcattagagaaatcagctatcgcggttccatcttttttgatgtcaacgttaacggtggtgtcagccggcaatacagctctgaagccattcggaagaatttcagacacaggcccgccctgtacgaggtattcaagcgcctgcttagccgtgctctcacttttagggagaggcagcgtttgcgcaacaacatatccgtttttatcaatgagataaagctccctcataacagtagatgaggcttgatccgcttttgcggtatcgcttttttcactttctgtttttttggctgctgttgtatttgaattggcacccgcttcatcgttcacgaatgtaacgtcttgaggcggatcaatttcctcggctgccttatcagattgaaacaaaccgcatccggataaaagcaaggcagaggtgagacaagtggcaccaatgactgcaggtccttttttcagcatacttttccctcctaaggatgtttgtactattatgtatacgagcctctttaggaaatagaccgaagaattccggcaaaacagaaaaaaacccgcaacataccgttgcggggaaaactatcttttaatcggttcttgcagtgagatacattccacatgcccgacttcatggccaaaccaatcgtctgcgatttttgcaaactgatcacgcgcccctgttgtcaggaactgatgatccggggcaatcggagactggttcagcagccctttataagagagaattgtgctgacttcccgggctgtttcatcgccggacgaaataatgtttacgtgctctcccatatatctttgaatggcttcttttaaaatagggtaatgggtgcagcctaaaatcagcgaatcaattgatgtgtcttttaacggatacagcgaggttttaacaatctcgtctgctgttttgtcgagaaacttcccgctttccacaaaaggcacaagcagcgggcaggcaaggttttcaaccttcaaatcagggtttaatgccaaaagcgcttcttcgtatgcattgctcttaatcgtattctctgtgccgatgacaccgatatgctgattatccgtcacttttatcgctgctctcgcaccaggctggatgactccgaccaccggtataccgacgctgcgctggatgtcatccaatgcgatcgctgttgctgtattacaggcgatcacgagcattttgatgtggtggttttcgagtaaataattcgtcagctcccacgtatattgaagcacctcttcttcagggcgcggcccataaggacaccgtttcgtatccccgacgtagataatattttctttaggtagctgtctcatgatttccttcgcaacggttaaaccgccaaccccggaatcaatgactcctattggttgttccaacaaaatcgcctcattttctcttcatttcatgctgcagtttcatcaaagatttttcgaagatggctatttcttcatctgtaaacgattcgaacatatcacgcagatattcctgtctttttgtaatgacctcttggataatccgttctccttcaggcagcagatgtatcctgacaacacgtctgtccgccgggtccttgacccgctcaacaagctcatttttttgcatgcggtcgattaagtccgttgtcgtgctgcatgccagatacattttgcccgataattcaccgattgtcatatctcctaattcataaagccattgcaagccgacaaattgcggcggcgtaatcgcatattggttaaggatttctcgtcctttttgcttaatgatcgcggcaatgtggcggagtgacttttcaatatccgcaacatgctccaaaggttttgatgtcatttgtccatccctcactcaaggatctcttacgcacaaaagcgttccgtgtctattttccttcttttttgaagaaaatgcaagactcgcaggagagaaatagaggactttagtcaaacaacatcaagaaataaaatttaatttatgacttgcctacgttttgcacagcattccaaatatggtttcgaatgttccaaacaaacagcaataaccggctccttccaaaagaaggaataccggcaaggattaaagctctagctcacccattctaagaagctcaacaacggcttgcgaacgccctttcacacccaatttctgcatggcatttgatatgcatatctatcgcaaactaaaacaataataatcacttgaatttataatggaaatcgactgttccatcctcgtatattacaagtttatcaataagcgctgaaaatgcttcgaataaatcctgatcagttctttccagctgtgcgaatgcattcttaatatttgatatgtcgattgtttcttcttcctcacgctcaagcatgaacagcttatcgttcagtttttcaatttgttcttcaagctcttttcgcttcgcctggaattccgccttagtgatcaactgatcttccaagtacaattcgattagacgttttttcttgttttctgcgttttcaatttctattttcgttcgcttgatccggtttttcttctgctcttcaaaatcagattttacatccagttttaacttcttgcccttttgtttcagtgttttaataacaaaagcccgcaagtccttatattgcatcggagcatggtttacacaaagagcagttccacctcgtctgtaggcgctacacttcaaataattaaactctttcttctcacgtttctgattgtatttgtacgacggtagcacaaccatattgcaaccgcacacaccacatttcatcattcctcgtagctcattccgagggttaaaacgctttttacgcatcttgtgttctttgttattagctttctcatactcttcttctgatatgatcttaggacaccagtctttgtaaacagtccatttttcttttgggttgcggataaattttttccgtccccctattttgacttgagtatgtctattggcaataaacacgccacaataaataggattctttaaaatcgtttgtactgtagacagctgccaaaactcagtcttttgaggctttacaatgtttccgagtgccaattcttcgttgagcttgagaacgattcttttatgtccatacccatgattattatgaagatcgaaaataaaacgaacgacttttgcttcttcttcattgatagctaggaatttaccttctttcttaaatccaaaaggtacacggccggaatgttcaccacggcgagcttttgctgctagtgccccgctggctgccactgaaattgtttgaggatattgggcagcaaacattgaaaacatttcaaatttcattgagtttttgccttcatatagactatcgtacccctcttcgagcgtcacaactcttacaccgtgggccaataaaacctctcgaatttcaagggcatctttaagatcacgagcaagccggctgattgatttaaaaacaaccatcttcagctttcttttttgcgccttatctaaaatgagttgcatcgcttttcgatcaagcagcactgtcccgcttatcccatcatctaattggattgcttcatctttccattcgtaattatttttctcaatccaatgatgacaaatatcaatttggttggctattgatgtcacctgttcatctttttctgaggaaacccgtgcgtaaactgcataagggtaatcttcatatttgatgatctcctgtgtttctgtctctttgaagaacactaaaccaccccattattttgcatttggtacattttagtgtgattatagcataatgattacgaacctcctatacttttccggttgattttcgaacatttgttcttgtataatttgttcaaggagttgatcagaatgaacgagggtatttatgataaaagatgggaacaaaaatttattttgcctgagcaaaggacagcgctattaaataggaagaaacaagtccaaaaaattgaaaaacccatcttagatgaataccaattggaagatatggcccgtgttatttgcgaggcgatggaattcaactcggttctggtcatcggtgtatacagagacggttttatcgaagaagtaaaaggacatgtccattacatagatgaagtaaaacagaggctgcacgtgaaggatttaaaaggtgatacaaattttattgcatttggttcagttctttcagtagagcaaaaataaaaagaaccagccacataataagctggtccttatctttaattaaagaaatggttatgtaaagctttagaaaatccaaaaccttcttctggtccctttaaccagagagaaataaacttttcgaaatctacttctttttcaatatctttcaaaattcttttaaattcttcagtaaagttatgaagagagacctcttcgccatttttaagtttatcagtgtactggctcgttaactctcttaatccttgatactgtttttcacttaaatcataagccaaaacttgatcaaataagccaaaccgatcataatcagctgctaattgttggactaaccttagttgaaaagcctgtttctcgacttttttttctaggttgtcaagcctttcttctactgttaccaattcaaatcacctcaattaaaaagctaagaaagtaaatacacttgcaatagttctagctgtagaagattttacaccagcatcaattagatatgaggaaacagtgtcaataattgcgtcctccacaacgtcacctcgtttaactaactcgtccaaagcatctgctacatcatcagtatgttttgcgaaggtttttcctgctgatccacctaactcatcgactacctcaccaacaattctcccaccatgtcgaagcgcactggctgttgccttcattgcttctttagcaatccattttttaataccatttgtgtgaaattcaccagattgttcagttgtattagttgataattcggatagtttagcaggagtttgataagtgacttcttgctgtgcctgtaatgttacctcttgagctttggcatgtccatccaacggaagaactaatgataaagagaaagttaatgcggatgttgctaaaagtaatttcttaaacatgaaatcaatccctttcttttaaattatttacatgtaaatgatagcattatatttcgactagaaaaataatgctttttactcaaatattagaataattttgaactatctgtaacaaaataaacaaaagtatctcctcgagaaagatactcaaggagactatttatttacttcaagagcgcttctagtttcgctttcgtatctggtccatatataccgtcttgaggaagcccgtacattgactggaaccttctaacggcatcagctgttttcggtccataataactatctatcccgaagtttttagcttttttatccggatagaaatgcaatgccgccagcgctgtttgaatctgttcaacagcatcactgtgcatcaatgggctcttcactttgaaaatgccagaaggcagattgaaagatgatttctttttgcttgagcttggttttttcactgccttggacgaagttgttttcttgctggatgatttgccgccaagtgcttttaattcagcatcaatagccgctttaacctcattccagcgtccctcgtctaaaatacggtgagggcaatactttccgctccaatcttggtgcttccgcactcgatcaataccccatccgcgttctttaagcagctgagcaacaaacttgatagccaacttttcagcagccctgtatttaggccctcctgacttgctgtagcagatttcaacgccaatagacttacggttcccggtaccgtttgttccgtctcctgtatgccatgcattgcgatctgttgggatgccctgccttacctctttatcatcaacagcaaagtgaaagctcgttgaacttgtgtttccgatcatatagctgacctcgttagcagcagatgcatcattgtaagtgttatgaatggtgatgtattccgcggtcatcggattagggcattttaaagcgtattttgcttctgatacaaggttctttttcactgcgattgtcataaatgatctctcctattctgcttttgaattagaaagagccgccagctggcagctcacttggttagattgtgatttttcaggacagctttttgctgatggccttttgcagtcacatagttgtttttgaaccatgctgtaaatgtcgtgccaatagtaaaggctatagagcccgcagtgtacagcgcatccgcaagctgattcacctgatcctccgtaatatccaaaggtgatttgccaagcatcagcattgtttggttgataagtgcaatcaaaagaagcaccgtccgaatgaccgtgcctttgtcaaagtttttcatattgtgttttcctccttatttttgcaaaacagtataaaaaatagcgattgcgccgccaataacgccagtgcatatcgctgtaatgatagcgccagttattgtgcgtttgatccaagttgtattctcttcgatcttgttgagtttttcgtttaatgtcatgatttgctggtcttgtctatcagaaacgcgttcaagaacatttacacgctgttcaatcgttttctggcctgccttcatttccattatctctttttgtaatgcatgcacatctggtacctccgtcacttctgacattagtacgccccccttatatctatttcacgtttttcacctccttagaggcaaaataaaaaagccttattgactggctcctgtcgtttcctcgtatggttgacctgttacttcttggtattggtcatgtgtaatgtattgtgcctgaacaccttctttcaagtcatcaacggaacaatcgttaaatgccatagcctgctttaccatggctgttgtggcccatttgtagaacaacgcaaatacccagaaattaagattcacttgtcattcctccctttaaatagagaacatctaattttaaagatgcaacttgctcacctaaagattgattcaaattttctgcttcttttcttgctagcacttccgcagtcaattgtacgcctaaagcattttgagccagctcagcctgttttcttgccagtttttcgtctgccagctgttgcccaagtgtagccagctgttctgctataggattggtttcaggaatactgccttgtttcagctgctctttgtattcttcatcagcagtttcaacccatgtttgtttttcctcatcgaataaaggccgccacataccctctccatttatttctggaggaatatcagtagcattcgccgggataatatatcttcctgactctctatcggggtgtaactcaaccggccttcctaaatagatcttatcctcaccatatgggtatattaatttcatacttctccctcctttctttaagttagaggcacatctaagtcaatataatatccattcactttagactcagtattagccattacccctgttagtttcatatcaccagatgcatatataataatcttgctgtaaccagtggttccgctagttgcaaccagtttgactatccctttgcttggagcgctagaagacgggatactagcaaatacaatctctctatcagtaagaacatgaccattaagatgcaatgtatttccgactttacggtattgtaaaggtctatcacctgtagttgccccgtttttgtatggaacatttagccacggcgtctctataaagtctaggtctgtaataacctctcgccacccagtgaattctccctctttatgctttgttccaatccatgtacggttatcataggatcttgttgcgacaattttctttaacccttgaggtggagcaaggtcagccggaacatctgtaatatcataatagtaccaggcagcatcatcatcccccggatgattcagaacacctgccccaaaataaaagccagtcggataatcaaaaaggttttgtcctttagttatctttattctctgaccgttttgggttgtcaggggatagagttgtccattattccatttgttcttatcttctttcgttacatgaatgtctgttttattttcatgagtattgacctttgtttgggctcctgctgagtattcgatttccatccaaggcgtccagttatctgatccactcaccttatttcttatgaatttccgccgattatcaggtatagaggttgttgcactggtataagctgtgaattcctgatatggataagtgccgtagttgtaaaccaataaataaccattgctattcacaggggcattcagtgccgttgaagctgaagtcatataataaaaccctgtttcaataacagtattgaaatccacgcctgacaagtttttcatcaaaccattgtcttgtgttaattttgataactgagccgcattccacttggttcgctctgcatcagaaatatgacgaatctggttatagttatgtgcgtcaaactccgttttggttgcctgtttgtcattggtaacattaccgagcccgacttgatcttttgtcaccccatgagggttgcttttatcattaatgtgttgttcagtatacgtttttgcatttttttcggctgtatcagctttgttttgcgcccctgtagtcgtttccttcgcattccaatttgaacgctctgtggctgtgatatggcgtgtggaatctgtattgtgtgcgttgaattctgttttagttgcttgctgcacgttgtctacgtttcctaaacctacttgggcctttgtgacttggttggggttatccctacgcgcagcaaattcatctgtataagcttttgctgtttttaaagcagaggaaacgtcatcctgcgttgccccgatctcttgcaattcctttagtgcatgataggccgtatactgataccagttgaaccaatccgcagggggatgatccattggtttgtatccttcatcaatggaggactgcgggggccgctgcccggcgttcccccattcaggcaattcttttgtaaaaggcataaacatcactccttaaatcggtaaagggtaatcatcttcaggctgaaagattccgccaagtgttcccccatctgtcccgtctgttgaaaatccatattgacttgtttctatagagttagcagaggacgaaaaacgaaaggtgccgtttaaatctacataagccacccgtacgcctgcagcaactgttttttgaacgatattcgaaaactgtgttgcactcattccaactttgctcaaagcctcaatgggtgccttttttacgataatggcagccggttcatcttcattattttccttgctgctgaaaatgtgtatttcacttggcttgcagttcagtgttttggctaaagcttcaatgatccggtttgtggtgccatctgaaacatttctggcaaccttgccgcgaataagcacacgataaatttcatcagtggcacggcccctatcctgcgacacgttgtcaccaagtagatccagagcctttccttttgccgcatcaatatcccgccagttctcagctgtggttagcgcgcttttaagtgctgtcagctgttcatcgacaattaaaaaaagctttccgatattgctcttttcatctttcaaaaaggcatcggtcagctttcctattaagtctttaatcatatgtgattcaccacgatttcatcaaaatgtacctgggcaacctctttaggttcaatttcaatgtttgactgtgaaaggtttgtcgcatctttccccatcctgattgttacatcagagacaccatctacttgatataccgcgttgaacaactgcgacaatataacatcatcgcccatttgtgagccggtatagtaagagccgtttgcatcaattcccccgattttataaacgaggttgtttttgatctgacttactccatcaatagggaaggaagcatttgtttttaaatccagctgcagatatattttgacttcccttgcaaaatcaaatttgacggcatggtcaagtccgctggcgtcagttatggtgacaacttgctccccgaccgtttcaattcctgcagcaacactgtcaaacagtgcttgcgcaacatcatcttttgtaccgcccagaacataagcatgaatgctttttggtgggttgccgtccgcatcggtctgcatggtattgttggcaacaatattcgccgatctgacgcctgacacgcttagcagggctgaaataatacctccgtttgtagatgctgaactgccctcaactgatttctttattcgtgcccggaattccgaatctgtttcctcgtcggcaccgcctgccgatggttccggatttgtaactgaatacacgccctctgagggctctgcctgcacggtaatggtatttgccgcaacattgtttataacgcccttagaaagcgagacagccgtccctgagcctgtcccattagcctcaattacaacatcttcaatcaattcaaaatagatgcctgattccgtagtaaactgagtttgttcttcaattacgatgccgggttctccagtaaaggacagagtcacaactgactccgcagctggctcccgcgtgatacccgagttgctgccaagacgatcgagctgcacgccctcagacttactgacaaagccgctgttataaaccctttctgcaatgtcccacaagccggcaagaaaccaagcaaagatacgaataataattcctaatggtgttttactggatgtgtttacatcctccccgaattgctcccgcgcccggtcctccatactatcaacaagctcggaataggtttgccgttgaaagcctgtttcatcaagcaagatcaacaccccctatctcaattgtttcttcatcctcttttgtcattttcacatgcaccgcaagactgcgagactctttatccattaaaaagttcaccgattccacactggcaatacgctcttcttgagaaatggcatttataatgtcatattgcgcctcttcttgatcaaactgctttcttaaaatgttgctgcgatcaaggccgacatgttcatcaagctcaaactctcctaaacttgttctaaggatcatttctactgattgagccagctcagcatcaccctcaaccatttgtaactcaccattttcaaaacaaagatccccgtctttaagcttgagagttttcatccttcccacactcctatgacaactggatcgtttatactgtgtgtgcgcctcgaatccggatcaaaggttttattgccgtccaggttatccagtgaacgttcagcaaacgaaacaaacacgcaggaccctactttaatatcagcttcgacgtgtttcaaaacaggcgcatgctcgattaaagggtattcatgtagatactcaccatcattggtttgaaacagcaatttcagatcggcagtgtgtttctcagcattgtaatttacaacccgtgctggcgccgttgtatggattgattgttttatccgctgttcgaatccgtcaaagaactttgtcgctttactcattaaatcaccctacattctgtgaaaaagtctttaccgtcaaaggaatgagagccatctttcacacgatattttcctttcgctgtcttgctgtttatttctatgattgaagcaactgcgatacgatgctgcaataggcacttcaccttataccctttgagatcatcttcctcaaattgttcaggcgtttccacaagtcctgttgcctcttcgagcttgaaacgttcgtcatccccttgactgagtggccgaataacaggacggccgcgccgataatacatgactgccccagcatcatgaatgacctcttcaagattgttttcaatcaatccggtgacacgatagccttttttataaactttatttttaggcagaatgatatttttcacttttataccgagcacacgcagaagcttatcgacaatttgccttgaggttgtgccagccttgaacgtgattttcatgtatctcttacggtatctgacctctgtccgagtgccataatttcggaccgttttatatgtccggccgttcttatctttttttacagtcaccactggttttgcgagcttgtaccgctttttcacatagtatttttcagcaggatcagcgttttcagtggttactttcatatgggtgtaatcatcgccatcttttgaatagatggccgttaccttattcaaaccgtcccaattattcagcaccttggtaactttaccgatagttaaaacaccgtaatcgtctttataaccagcttgaacagtgatagtgctgccttttttaattttgctgattgaatctttgctcaggttgtatatttcaacctttgtttcattcggtttaaagtcatcatcaaacgggacctcaaaatgaatctctaagtctttataatcgaaagtggtttgtgaactgccgttatctatcgtgaccttaacgacgcgcccaaacagcattttattcgtcgccatcgtcttctccctccgcatcgtccgagacatcatcaatataaagaaacacggtttgcataaaattctcgtatgtaacccgtgtttctgtattcgattcatccatagggataagggaaggcgcaggcagtttctcgtttacaatgtcttcccacaaagggacgttcaaaatcaatttttcgcccagcacgattgattccatgtcttgatcatataaatcaagtgaaaaactatcgtctgtttggttgtaattgatacgcaaaatgaacgtgtcatctgctaaatcaaattcaaactgctgtggtatgtcctctttgtcaaaaggaatgtaatctcttgatgccatgcctttccctccttcatctaatcctcattttgacccctatcggaattcttcggtccggccagggattcaaccgacgcaaagcatttactgtggtgccgtatttacgagcgcagccccaataagtgtcacccttcttgaccttgtggtataacttgccggatttttttgttttcttcttgctggctttcttctttttcccggctgttttcactttctttttgacccacgggctttttgcaatacggatttcttgcaactcaattgaaatagcaaaaccgtttgtgtaatcgcctgtgtcgcgatctatctttgtgatgatcacatttttagcaaccttacgcccggtataagtcaaaagagtgccggcataagcctgctttttcagatattcataatcactatttgctgttttgcctaataaatagccagagactgttgtcgtctctggctttctttgtacatggtccgtgatcggaacccctttttcaacgggatatgaagtgacctccacatccgcgccatcagattccttttcgtttacgagattaatctttccgagcttcgccaattaataagccccctctggtggataaagcgacttcagcatgtcgaaaacttcgtcaaatgtttcagttacagcctttttcacctttgtttctgccccttcactgccgccctcaacttttacgttgatcgacgggttaaaagtgatattgacagatgaactgtttgagcttgtagcagccttttctggtgtgtaaccagtatccgcgccaagctcccgaccgagtgcagcatacattccgagtgattggtttctgtatcgtggctcagttgtgatgacatactccctaaagccgttttcaccaagcgcagcgacttgtgggctgttaatgactccacctgtcgcataacctctatacggcccaccatgagccatagaaacgagcccagggtgttttaaaataccgccgtatctgctgttcaaatagttgatagcagcaaggatctggtcaactggatttttgatatttccgtgacccggttccttgtgagcgttgaatgtacttggtataaactgcataagcccttgtgatggatggccagctttcgcattcgaatcccaattgttcacgacattaggattcccgcctgattccttcatggcaatagtttcaagtgcgccagcatattcagagccaagccccttgattgatagcgcttgagctacccactttttgacggcttttgaaccgccacctgaaaagctttcagcgtaactggacattttgcctttaacaaaaccaacggccttatctttgacaaagttaaaagccccttttgcgatatcaccgaacgagccagccatagaaggtgcagagacacccattttttctaagacttttgttaaaagcttagatgggtgtccgatgtaatcaaaaacatcaagagcaacatctttcactttacctgcaacggattttacaccattccatgcttttgtgaagatatttccttctgtacctttcgcgtaagctggaactcctgataaagcagcccttgtctgtttagcagataacacctgagtgccttttgggaggttcattagtgtatcacttgcagggctgagtcccacatgacctgatggagtacgatacatttcaggaccagcgtttgcccctttaccgtctcccagtatagccgggcctcccgggtgtccgccggttccgtgtgcatacttaggtacaggccattcaggtatatgtttatctttcaaaccgatcttatcaagtacccagttcactccgccgattacaccatttactccttttccgagtgctccggcaagtttgttcgctaagctagtcacaccagacacagctttatgagccatgttcttaattccatcaccgattttacccggaagtttcttggccccttcgactaaatcattgaaacgatccataactttttgacgtaaatcaagcgccaataacgcgactttattttttatataaagccatctatcagtgattgctgaacccatattacttacaagctttttcaccatgccgacagcactagaaaaaatttgcttcactccgtcccacatcatgcggaaattcccagtgaataagcctttgaaaaccttcactattcccataataatgccgattgcaccctgtattatcgcaatgatatttttaagtgcaacttgaattattgagagcacaaccgggaacacagcagtcacgatatttaggatgaaacggatcgccggaatgaccacagttgtaatgatattcgccagaaattgcaaaagagaaacaacaatcggaagtaccgcttgtatgatttgcatgatctgcgggaatacctgctgcacaacttgaatcaaaataggaagtgctgcttgcgccaactgtaaaatgattgttgccgctacagtaagcaattgagccacgattggaagaacagccatgatgacttgtttaataatcgggaacacttgctgcaccgctgataaaattaacggcagcacttgaaccgctatttgtccgatggatgaacctaaaagctgaatcaattgcaaaacaatcggaagagcttgttgtacaatgctcaggatcaacgggaacgcaagctgaatcatttgaaccaaaatcggtaaggcattttgcacaattgaaacaaggattcctgagaaactgcctatcaattgaataatgattggcagcactgcattaattacgctcagaatgactggaaaaatcgtctggaagccttgaacaagtaacggtaggatgctgcttgctatttgcaagacactcgtccataaagtacccgacaactgcatccaagctgaaagcaattgctgaatcagtggcatgatttgcggaccgattgtctggaacgtttgcgagatagctgcagcaaacaaaacaagcgtgccgcctatttgaacgaaagcctgctgaagttgtccggccagctgctgaaactgtggcgtcaattgcgtaaccaattgcccgaaagactgttgaagcgtgttgatgattggctgcaatgcctgaaaaacagtcgttagaacagattgtaccgatgtccatgccgtctttaaggcctggcttacattttggtttgtttgttgcatgcgatacaaggcgccagcaacactcaaaatagcaccgacagccacaccgattggccctgacactccgaggaatgcaagtccgatcgccgcgacaaacggagcaacaagagaaaccatacctttaaagctggatagaccgactttcaactgctccatgaatcctttcacgatgccgtttagaccgtctgatagtcctttaccgaagaagtccgagactgtctttccggcattatgaatgaagcctgacacggttttcacagccgttttataggccgactcaattccagccactaactgtggatgcgattcaccgagacgatcccataatttcaaggattcagcctgcattttatgaatggctgtgatcgccacgttttgtgcgtccttgaatcctttcatgaatgcaggttttaaaccctcagcttctttgatcatggtatggaatgcaccgacaaccgccgatttccccatgtcagcaaagcgtttcatcgcgtctgtagctggcttgaatctttcctgaagcttatcgaaattcttgtacagcaaataaatgccggttacaaggagaacgattgcccccgcaacgacatacaccgtgcccgacatagcagccagcccggttacaactggaccaatgaacatccacaaactgctgagagctccaaggaacccattaactaaccctacccctatcgctagtggcgataaaagtagggttaaaacagggatgagaagcataaatccttggatcattttcgagagtacagggtgcgcctcattaaactgaataatcagcttcgcaacggccgtaatgcccttgtatatcgccatcgcaaacgccgcaaacacttcgattgctggctgaatggctttcagtagtgtgctgcacatctcttcccatgcctttgaatagccgggaactgtttgtgttgctgctttatgaagcccttggaacatgaaaaagtttgtaaaagccgcgcccagtgccaccatttgaaaacgcatataaccctgagtgatcatcattgtcatatcgttaagctctttcatgttggcagtaggtccgagcattttcagagccaaatgcgcagcagttccctgctttgccatgttctcaagcgtattcgatacggcaagcccagctttattgacttgatataatgggtttcccattcggtcatagttcgccgcaatcttctcagattgagtggaccgagccatcaatgtccctacagtctgcagcatgctcatgcgcatcattttgttgtttttcatcatgttgtctgttacttgcttgtgagcacgtcccagcctgtacacttcatccataaactgctgattggtgccagaccagctgtccatctggttccctaactgaaagaaaccatactgggctcggatcaattcattccgaaaaccgttcatgccatatcgttcttcatgccaggcttgacgcatttcattgagcattcgtattgtatcggcttctagtccacgggttgagccgcgcaaaaagtccatttcacggttatactgccggattccccggtagtccggggccgggacagccaccgcagccacgttattctgaacgctttgcgtgttctgctgggtaacgtttgctgcgggcgtaccgatacggctcatatcgacgttattcaaattttgcctgagttgatcaattgattcattggcgtttgttatagacgtttgatcaacattgatattaacctcagacggaaggctttgaataagtctgcttgtctcttgtacctgggtattcagctggctcaaacgggatgtaactaagtcgatttgaggccctagccgttctatcgtttgactggcagtttgcaacgatgagttgtccaagatcatactcatatggatgtctctaaaattccgctgttgcctttgaacctgagccatccgtgtacgcatctgtgaaaaactgccgccagcatcgccgacatgatcaacgagtctatctatttgctgatttgctctttctagaggggaggtatcaacgttcaattcaacgtcaatatgcgtacttcttaatgcttctgacaacgttcataccccctcatttcttgttattcctcttgttttcttgctcaatatggatgtcgagggctgcatttgcctccattagggtatcgagatccatcatcgcgacctctgagaaggagaacttcccagacatcacgagtctatacataggccagttgtcactcgccttctttttgtaatacggctttggtttgggtttcgtcgataagaaaggattgaacctctttcattaattccatgaaaccttcgtgttcatcgaaatattcaaagctcactttcggttggacaacgacttctttcatgaataactcatacatagcagctgaatttggtttacctaaattgaggttgactgcttcgtcctgaatttccaccattcgctttgttcctgggtgttgaagagtgtactcaattcctttgatagttactttcttttgtttaccgaattttgacataggttttccctccgcttgtttagtttgcatatattgaaaagcagccctattggactgctttcgcgcgtttgatttcttcttttttgccatagcttaattactgttccaatactgtatagtcaaagacttgaatctcgaactcacgatctccaatctcgtcactgaattcagcatcggcaggctttttgaccatcgcttctgtgccgccgattttttcctgtccgcccgtaacccagatagggaaacgctgggccgtgtttgccattttattcaggtatggtacaaatggcgatcccatggaaagagtcagtgtaattgttccgagtgggttgtttttcgttgcaacactgacatcacccttggcgctgactttagtcgagaacttttcttcgtcttttgcacaagaaaccattgtgccctcggaataaccggttacgattttcccgtcaatgttcgtgttgacttcgtttgcatcataaacgtacatgctttatatcctccttaaattgagatttcaccagtgatttcagcagaatgaaccgcgccagccagttcaaaagtaaatgataggccgtcgtatacacggttttttctgttttcatctgtgatttgatcacgggtttttgtgctgattgaatacactggctgcccgtctgcatcttctgcaacaatgccatttgcaaaggctgtttgcagaacgtttgtgacctgtacactcagcaatgaaaaaccagcattcgagaacgggattttgccgttgtttgagaatgctgattgtattgaggtttcaatattcaatttcacccaatctttgccgtgcagcacgtcgatatattccccggatgcagtaatgccctcggatgtctcgttgtggcccgctttggttacataagcaatagccccttctgtatgcagctttttcaactcgtctgccttaatatcttgaggcgtgatgccaacgatatttttaaatttccaagttactgatcccactgtatgtgaagcaaccgaaccaacaaggccagcgtccggatgctcgtcatttaacgggtgatagaaaacaattgtgcgatccttgcctttgtaagaagcaacttcttcccggtcagttacctgtaaaactacaaatttatatgatttctcttccatcgcttttgccgcttccattctttcgtccgctgtagcatcagcaaggatcaagaagtgccagtccttgtcgaaatactcgtcaaacgcattccgaatggagaatgttgcttgtgtagtcgctccttcttctggcgtttctgtgctgcctccatacgtaccgatggcaacctttgacggtgcattgtcaccctgagcaaagatagccgcagcctttttatatgctgctgtggtttccggatagtctgccttgatagcttctaatgagccatattctttatatgtgttgtgtccgtctaccttcgcaagaatcagaggtgttcccaatcctttaaggctggacggtttcactaagtcaattttgactgtaacgtcactaagtggcatatgaattaccctcctgtattttcaattcgtacagagtcgaaaacctctgcatttgcttctccatgagacacacgcgttctaaagcgtgtatcgaagccgtgacggcgttctgtgtcaatcgtgataaatgtatctcgattgccgaaaccgtcgttcctgacccatgccagcccattatcatgaagcttttgtcgcgcttcagctgttttgaagtacgctgctgtttgttgagcaagggaaatggcctcaatatggctgtttgaaatccatgtaaaagagaaaacaagctcgatgtcttccgttaacactccctgttcttcaatgcctctatgttggggcaaatacggggaagtcacggtatacgtacaaaaaggatagacaggttgtttccctgtaccatttgcaacgataacgacatggcctgttttctctctaatcagtcccaggactgtttgtattatgctgttgtagtccatctgaattgatcaccgcctttaagatatagctgttgaaatcggcatacgtcccataaggcgtcatcgcttcaacatcaaaggtggcgccatcaaaaatcacctgagcttttagaggaatttcgttcttgataaatagctgcctgtccatagatgtaagccggccgccagattgatagacaagttgtgactgtaaaggtactattgcccctctttcatctgacttcgtcggtttcggtggcacccattcgccgagatcatcatatgaaccctcttcagatggaataagcaatgtaaaatcaacgctgtaccgcttaatcagatcagaaaatatgaaatgattccccatcagctttcaacctcataatccatagagccaatcatttccccggtatcaaccaatggatttgaagagcctttctcttcggttgtaaatggatggtttgccgggttccgcaagtctcgggcatacacttgaagccgccctttcgcaagcaggccgactgtttccatgatgtcattcatcgaatcgccattctctaacgctctattgaccagatcctctaccttttgaacgatctcttcctcgttctcgtcccatccagcacggatgaaagaacgctccggaatgttgatatattgagtttctttcttgaggtacagcccttttgcagcaaggtagttccgcatgcgatcagttacagcaatacggcagccaaattcgtgaacagccgcgatcatttgccgttcactgtccaggattccaactttcaccttaccgacggaaccgaggtttcttatgacttctggaatacggttgctatctcgtacccggacgtttctacgtgccattagatcacctcagtgccctaaagcgtatttttctgtagggtcggaataactcatgaacaggattgagcctttcttcatcagctgcataggatctactcatgcctccaattgattcagatagaacaccggacgggctttctctgtcaatcttaattaatagggcaatccccttttttacggccggaggaagagacacagtattatctggaccaacaaagagattgttgcagtatgccatcgcatatgaaatactatcttccagatcaatttgcagtttggcatcctgcgatgtgtcttcagctggaatccctaacctgacttttaattctgccaagtccatttttctcattcctttcaaagaaccggttcatatgtcgcaaaacatcggcaattaatatcattggatggatcaccgctttgtcccggcgcttctgctgttacatgaataccatttttattgatgccaagatcaaacaactgattgaccatgcgttcctgcccttctaaatggacatgatccgcatgttttgtctcacggactctttcatcgccaacgttgtgccaggtctttttcatgttgatgccccgtgactgagcttttttagcagcgtcaagcgttgctttttcccttgtgcgatgcatttctgtattggctatgcgcttcgatcggttgtaactcaggccgacatctgtctgcagctccttcgctatctgagcaaagcgtttccgctcaataaaaccgcgttcgattgtcttgttaatctgctgtattgtctttttgcgatcagtttcaatggctttgtccatttgtttacttttaatagcctgctgaacgtctccgggagcccattcagcaggtaaattcatctgattcagtgttgcttttggctgcgcaagtttgatccctaacgcagccagaacgccaaatatcagccagctgtaagatgattcgtaggtttcttcaaggaattctataatcatagctttgactttcgctgaaagatcactaatcaacgaggtgatttcccgctttatacggtttagatcaccgtgtcgattagcgtcagcaagtgtcggttcttcgatttgatcaagcttgacgaataacgcagtcagctttgacagcacctcttttgaagcacgctgaaaaagccgcttgagtttccgtaagaattccttagttttacggttcaacggcttcaaaagctctttttcagtttgttctttatccaccgcttaccctcctactcctcggctgtttctttggcgtcagactcttgtgtgtcctcggcttcttttttatttgtgcccttgtccagcttatatccaagtcccttataaattacctcgaaagcacgttccgtcacttccaaagagtctctccccttcttgatcctaaccattaggcagtggcacctccatcaacagcagggactaaggctgcaaaggcatcctctgcaagagtagtgaatccgacttccatagttgctcgaagtgcgaacatgtcacgctcgaataagtttagaggttcgccggcttcatctacagttgttgtcaacgttgcatcctgagaaatggtatattcaatgtcctgaagaataccataacgcgcatagtcccaagcccctgtaataaggtcagcttttgttttatcccatgatttgctgtcaacaaacccaataggcaacccaagagcttgaggtgttgcatctgctgtcacttggttaaatagtggcagcccgttattatcttttgcagcgcgtaacttttgacggaaacgtctaatagttgtaaatgcatcaggatctttgtctgcatcttctacaagcgccattactgcagcgagatcgtcataaacagttgcccctgaacccgcgccagtaccagatgtgatcttttggccggacttgttgactctttccatgattgatacacctgtctcaaaaggcgatcccaccccaaacagtgcggcttggtcaaacttgattgcaaaagcttctctaatagctgattgcatttgagtaaagaagtcagcaactgtgtagcgtaagaattcttttgaaactggaatgataaccgcaagtttcttcgatgtcatttttgctgtgagccatttggcgctgcttgtttgaatgcgttcaccttcaccaacccagtaagcgccaggtccttctgctaagtacgtgaatgtctttaccggttttgtcatcggttcatatttagcaagctgtgtgattgcagatgtctgcataaattctttcaacacaatttctgcttgttcttctgggattttcccagttactgcatcttgtagtaatactgttttgggattaaatgttggcataatagccctccttattttctgatatttgcttggttagcgagtgccccaatatcaaccgccccgccagctggtgttggatcacctttttcgaagttagtgccgctctctttgaatttgatatctacagcattttgaactgctgcattgaatgtctcttcaaacttactgagattggcaagtgttgtttcctcgtcttcgccaataaaatagtcaataactcctttaggcagcttcttttcatccgctacattcaaggctttattgaccaatgcttcacgatttcttgctttttctgcatcttctatttgttttttgagcttctcaatttctaattcagccggagatttatccggattgcgttcacgaattttctcttcaacgatgctatccaaattgtttgccttccatgttgcaagaccttttgtgaagtaggaatccaggcgtggctgaatgaatcgttttccctcttcagtttcaaggaacccttccaccttatctgctgatacggccgaaagttctcccacaaatgcttttacttgttcattgtctttattatcttcgagaaattttttcacttcttctaaagttggcattacgtttcttcctccttcgccctctacagtacgcgcctgttatgagtgcatgaaaaataagcctttttaaagtcatgctcaggacaaatacagatgatcactttgcaacctctttgaagtcatcctcatgtcgattcttatgccagtttctcgttgtattgtattcatttttcgctaattcccattgccatatatctatttcagcaggcggattctctccatttgacaacgcaattgctttctccatagctttttcgaatgtagggtagattcctaccttatggggatagcagtcataataatcatcactcgtgtactcaacttcaaagaacgtcattacttacacctcgaatgtcatcattgtccttttcatcctcaaaatcataagcatcttgttcagctttcattctctcaatctcgtattgcacatcatcgacaatagagagtgttgaaaggcgtgtctcttcgcttacctgacctttaagttgtccggatgtctgagcctcttccaagagatttgacggcagattgcgcttgaatgagaaccatacctttaaataatcacctgctgatacaagaccttttttcgcccatgctgagcaaagcaatttgtactgataccgaagggcagcagtcgttttcctctccatcgtgatgcacttattttcaagggccatcagcttgtatttcattgcaacgcctgtcacattcccgccgaatgattcatcagagaaattgaccgactttgcaaaacgaagaatgttttcttcaagcctgttcagatggttttcgatcatggtgtcattaatgtcttttgtcaggaatttggcatcatcatctttcccaaacatttcaagcacaccggtctttttcagttcttggatgtcttcatcatccataccagcgccctttaaaatcaaataagctagccgtagctgttcaatctcgtttgatgcatctgaaagtgtgcgatcgtatgcatctataagtttaattaccttttccacgtcgcccatctgttcatcattgttaggcaacccgaataaaggacaataatcaaacaagtggagcttcttctctaataaagtccagccacctttttgtttttcgaaaaaataggccatcttgtcatcgtaaaaagtggctttttcacgctctatgctttgattattgacccaatcaaataccttataatatctaagtgcgaaagaaggctctgtgatgtcattctcagcaataatgacaacttcccatggatttacattcgcaactcttaccgagccgtcaggagcgatatacacaagtctagcaccatatccacaaatagctgctttcttaccccattcgctatcagcatcagcaatgttatttatggtgttaaagttattgatttgctctgccaaggccgtatttttgttttccccgtctttctccgtctcgtatgagattggatggccgaacatatacccaacctttgtatccactatctcagcatcaaaagcattattcaggcggttgtttaccagatggtcaatacgccgaacctttcctgtttcaaaatcatcgaattgagctgcctcccgctgtaagatcggcacaccggcaacactagccatatatcgttcatactgagctatggctttatctttgatcggcttatgctcttcaataatctgttcaatgattggaccgtctatctcattatttcgaagataatttaaaaacttgttcatgttctcacccctttcctttgcgtctcataggtttgttgtgtgtataaatggcatatcggatagagtcgagcacatcgtcccactctttaactggctcgcctgtatttggattccaaacatacataaagatctcttttttaaagcgactaactttatcttcaacaataaaaagcagatcccgtttgaacagccgcgccacttcttcgatacctgaaacaactgccttatcagcatctaacgcacgcaacttctctctgcgaaaacgtacgatgtgttcaggccgagctgtatcacaatagaaattaatgttgccgtaccgctctttgatgtctttcgctaccttcacccagtagtcaatctcttcgtgccgcttgcaatgttcttcaagcaaataaaaacacccttggtcatcttgtccgattacgacaatagaacccgggtgatcatatccccagtcaacaccagtaaagtatttagtgaagttgacttgtttatcttccatttctttagaactgatatagtgcttgtctttgttaaaatccttgtatattacgccttccggagcaacccagtagccgtaaatatccctgtccgtaaacatgccgctcggtgttgaagcaacaatactttcgacatactcaggatcaagaaagttgttatcaaacaatgagaagtgaaaagaacggatattcagcctgccgtttttcagccgctgcccgtctttgtcgatataatccgttttgacggtgtgcattgggttttcagggtttgtatccatcatgaccattgcacccttataggagcaacgagaaatgacttccttcacgaatgaatcatgcagggcagtcgcttcgtttaggaatgcgccagctgatgtgaaaccccgtgcctttttccatgagtctgcatttgcaccatcaaagcaataaacacggtttccgaatatctcaacggcattcgctttatcaaggcgcaattcttttccaaggatcagttctaaatcatttaggatattccgctttatagaagcctgagttgccccgccaatgataaaagaaagccccatgttttgatatttgctgatgtgcccgaggaacgtcaaaaggagcacgaatgttttccctgcccttttcgccccgctgcatattaagattttcggctgctcttcaataaagctgttccatacttcttgttgcttagagttaagttccatgaggtttcaccatcttccgaagcatggcagcaacttcattttcttgagagtttccgttatcaccatcaatatctttcttcgccttctcgatattcaagcgcatttgctccaatttaaggcgacgttcgtcttcttcatgcgccagtagaacaaactgttttatcaagcttctgagctctcccattgcccgagattgagcattcaggaatgtggcctgacgatcccaagcgaactgtatttcaagttcttcctcaacaatagacttttcaaaatactcgtttccatcttcgtcctcttgaggttgataaacgtattttgcttttttctgttcttttacaagatcatctttatcttgtacgaacatgataggctgcgcccgaataatggctgcatattgaatctgtatctgatcccatataatatcagcaggcgaccgttcctgaatctcttccatgatttcaagcgtttcttctggcaggaatttagagaaaaagccgtgagtcatagcgttttgattcctctgtggtgcgccgccgttattccctaatgcattcttattgccgggtggtgcgcctgccttttttgtgtgcacacttttttcagtgggtgcacccttttttctttcccaaccatgccgctgtttccacgattttatggtgttcactgacaccccgtatttctcggcaaggtccttgtatttcatacctttgacgtaatctttctgcgcctgaatgtgcttctcagccatctacattcaccgccgcccccttttgaattgagttgttttggaaaaaatattccctctaaaccaccaccgtgctcaagccgttaaccgccaattgtctatcctgagacttaccggaagcagtttacagagaacataaaaaagagccatatagtttaatggctcttcctttattcaacaatttcaatatgtgtaatttgagttgggttaataagaatagattcaccaagatcaatcagacgatttttcaaaactctttcaccatccaattcatcatgaaaatagtctataagattttccacatctttcatatcttcataagaaatttcaaaagattttttattactcattagtataaacactttcataattttcacctcccacctaattatcggataaggagtgtgacaagggaactatttgcaaaatttgtcgaacgaaagcgcccttcataaataggtggcagtcgtaagacaaaaaaagcatccccaagggatgccttatttaatcaaatctcttaattctttaattgtatggaaccattcgcaaaatttgtcgaacaaagacaaaagaatatcactttttgtttcttttttttcggttgttttttgtctgtgtttctatttgcacactttcagtttttttgtttttcttctcttcagtttctaattcttcaattgcttcttctaatagcattttataagtacgtagttttccataataattaagattttttgtcacaatccatatccagagaccgattaaaattaataataaaatcccgttaaatattactatataccttccgaaggttaaacccgttttcacaatagtatctaaaagttctgtcggatctatagaatgttttttatcaatatttactgctatgttggagaaagcattaaaagtgttaaaataaaacgtaaaaatacctattagaacactgatgagactcgtaaatagtgatgtatatatagcaaatgggatagttttaaaagaggaaatgtctcctgaaactttaaggctgttattcaatctggaaattaatttttttatttgttttggttctagtttctttttgactttctttttaaaatcttctccacttttaatattggaatcctttttataaggtgtaccgaaatgctctaagtatttagatacatgagttacttcgtcaaacggaatttctctaatttcacgattatctttttttcgataattaaacacttttctccataattcaaccgctaattttttcactatatcacctcctatattttatcggacagacgacaaaacttcgaattgcttgcaaaatttgtcgaacgaaagctctattcaaaaagtcagtcttaagacaaaaaaagcacccttcagctgcgggtgctcatttcttcctatgcttctggaattccaatatatcctctttaataaaaagcctgtccctcggcatttctttaaccggttcaagttgaccggttttaattagctgattgagatattgacgagtaaagcccaatatttcaatcgcttcacttgtattaacgatctcctcattcaagaactttttaattgcatcacgctctttaaggctgtacaccaagcatcatcctcttttttctcgatatttttgataaagggaaattgacttttccacaattgaaacagcaaacaaaacaattatgcatatatctaaagttgtctttaatggactggctgcgacatgctgtcgaacaaataacatgtatcccaaagcaagaaggacaaaaatatcagttgacattcttagtttttccatttgtttgaaagtggctgctttcatcgttatataattatttgtgtcacttatgttatacttggagcaagggagaagctccaccttctccctcggctcaaaatcatctacgctttcttggtcgtctgcgtcttttgattttgggcttttttgttttaagcttttctcttatgataagagctttttcaaagatagtgagtgctgtaagtatgatgcccagtatcactgcaattttagccactttcgttcccccctttctatactttaattatatacgattactttactcacgtcaagttaatttagagaattttttcctgttttctcataaaaaacacctattcatgctaaacagaataggctgtgttctgctctatttttcattttcaaacgggaacgctcaatgtttttctggactgttccttttttaatgttcagcagctgggcgatctcctcgaaagacatgttttgcacagtatgcatgatgaaaatgtccttctctctttcagtaaggacagaaagggcatcagcaattctttctttgtcccagtcgcttacctctccttctggctcctgattgatcgcatactcttctggcattgcatcaatgatacgaggatcagcaagaatcgttctttgataaacgtctcttctgtcagctccccggcgtgctcccggttgtctcccgttctgcagccattcgagagtgaattcaatatcgctaatcatactgccaatgattttcttatcattcttttgttccgctgtcatttcattttctggtgtttctgagaatgcccggtacatctttctcgcttcttttaacgctcttttgtattcaatgattaaatcctgcatgtttgtcctcctcttatttacgcttaaaagcgccgcctttgcatcttctgagtgtttgcctgtctcgcctgccaaaacctttcagaacgctccttcgcgtttttactggactttttcttctcttgtttcatttcgtccctccgttcaaataaaaaaacggacaccaaccaaagtacagaattctctgtacagtgatcagtgtccgcaggctttccatcttggactttatttaaattaaatgttttttcgctatagtaaataatggcatagctatatcaaataaattcttctcaccaacttttttatagactactatatttccatccttcgttaacaagacacttagaatatcatcttcgttttctattggattcggcacatctaaacgcaaagcagaaataattccatcactttcttcataagaactccaattttgactcgcggtaacagtacccccacctaaataggcaacttctacatcggctatttttaaatctctccaccaaccaccttttattgcagcattatcattttcttctaattcttcttttagttttcttaaatctatagttatagcttgtgagttatatcggttatccccacgtcccacagtcccatcgattaatcgcttaatcccgtgttcaataattgattttttggaaccccaaaaatataaaaaatcatcatctgatttagccacattgaaagtttcatcagcagaaatagcaattatatcgtgtgccgttccatcttccaaatagccttttcctgtaaatgaatctcctattggatgtattacttgatacttttttaaatcttcttctgtatattcagtactacctaggtttttaagcgtagttttaaaagattgactttcagaaccagtattaaattcatttgtttctaatggtaattgttctgggaaattgattaatctctgcataataattgattgcggcatttaattctctcctcacaaaatcaatttaattactttgtccaaagctttaattaaagatgttctttgatttgtcaccaaaactatattcttttcatgcgcacttaactgtacaccaggattacttttaattttaatattaaaagataatatatcagatggcttaacctctttaataaagtgttttttcatgaagtcaacttttttagtgtttttagcaactttcattgtatacttattctcttccacccctaaatcatcacaaatcctctggtaaaagtgaactataaaatcttcaataatttcttgtccatttttatactttaaagtagcagatgcacttacattcaaattcatctgaccaaaattatctgtttggataatcgagaaataaatcttgtatggtttaatgtacattttaacgttgttaaacttatcaaaagagacttcgactaactcatttttgcgccctgtatgacctttattttttagtaaatcataaaaaattgtttggacttccgtataatcatctttaattttttgtagagttgaattttcgactatgttaaaaaccgcttgaaaatctatatcaaaattatcgaaattaaagtgatttttcacccatctaaaacccactctaaatttttgggatttgtcatatatagttttaagtaaagctgctaatgttggtaaaataatgattcctgttgcccaattaaatccttttgtgtaaaactgaaaaagcattgttgcaagaagactgagtagcattaaaacccacatcatctagcccccttatctaataatgtcattaattatagccataagatattgcttggtaaacattctttagaattaaatcaatcaacttcctctgtctaatttacaacaatgtttatcttttccacagttttcagtacaataataccatttattttcatattttttctaatttttttcaccctttttcacccctccatcgttttttcttttttgatgaattattttcaaatctctatttcctcctcaactcaacgcccatgctgcagccgcatttcgggcagcgtgcatctgggcggatttttatatctaattcgttgtgaccacattcaggacagctgtattcgatcatggtgtcaccccctattcccagccgactgcaattgcaaagaataaaaccaaaaccatcgccccgattagccagccatttgtcttatcacgctttgcaatgattgtttcatcaccgatcattttcaaatcgtctgactttgccacgagaactggtatgtaatctggatgcactttcaaatattccgccgcctgctcaactgtcatcgcttcgtctttcgtggctttgactgcccgctgaagctcaacttgtaaaggaatcatttcgcatcaccttctttcccaagcgaatcccaatcaaacgtttcaagaatcttaagcaaccgttcaacttttggtgctctccaagctgtcatagcgtacgtatgagcttctgaagtgtaatggtgcttgttcaatttgatgtggctctttgcttctgcttttgtcaaaaacattgtatttggttgtataatgtgaacctttctttctggaattaattctgcttcttcatcaatgtatttttgaatccactcaacagcatcttcatagtcgtcctcaatttcttgcaactctgttaaggcttccttagacagctcactatcttcttttatttcttctagataatcatcaaaaacataggcttctgcaatatatggcaggtatacagaataacgctctgcgttttcctcccgagcttcaacccattcataatcaccgactgtccaaaaccgtggtgcagcttgagaatcacgatcctgtgttttcaattcattttgaagctctttcaaaaattgaatatccttgttcatttcacatcaccctccaattcattttgggcaactgttatcgcgaaattgagattggtaatgatcttctctaatgcctgtttgtatcgtttcctatccccgcttaaatgctgaatgtccttttgagcctgccggaattgatgaaccgttacttcctgctggcgtttgttttcctcgatgatttcccgctgtttttctactgattgaattagaaattcttgatcctcaagaatagtggaccaattaacatcaattttctttttataaagtgaagttgctattgaaaatctattttttatttcctgtaatttatccatgccgttcctcccccgcaggggaaagcccctgctatttgattttgaaacctatttcgtgatcgactcgagcaaagcttccctttgccgtttgaatgattgttttgccatgctccggggcttccaagacatgtgcggtgccctggctcccgtctaaaacgatgatctgtattttgcccgactccattgcctgttcgattgttgtatctttgcttaaattaatttctcttgggttgtacattcttagcgccccctgtgctatgatagaagtaccagttcatatcagagcatcggggcatacgcttcggtgctttttttgtgtttaatagtgatccggtttccatccagtcattgtgaatgttggcgatggtttcagatcctcacggtaaacgatcgggtgttttttcacgtattcggccagctgttccggcgtcatcttccattcttcaaccggtcctggcaggtaaggattgatgctttgctgttccatggtatctacctcctgaattgattttgggaatttccgtgccgccgagcttcttgcaatcagaacccattcggctggcgcatgccttaaactgagagcaacgtgtcatacaggccatgagcttatcttcttcctgcacccacaacggccgatcgtctgcgattaccacgtttagcagtggactttcccgcctttcttttgagttttttcagctcgtccagctcgatgaagccgagtgacttatccagagccagcaccttgagtggcgtatcgtaaagccgctcatacagcttgcgcttgatggcaaattcctttgtttcaacgcccttgatgtcaatgatctcgatgctgccgtccaagttatgaacctcaaagtctgcaatatattcaatcttccgaaaagttttgccgttctttttgaatgcctcttgcagcaggaaccgtggctgcagcttaaaatctttgatctgcttgctcaccttgagccatttcagctgctcatagtatttggcttcggcccggctgtcgaacgtgatgccgtctacctgtgtttttcttgcgccgtacttatttgctggcatgtgatgcctcctgaaacttattcttttgttctgcaatctccatttctgacatgccgcagtcaatacaacattcatagtcaggtatttgcaaatgaccttctcccggcatagtgcagtaactcatttccatgtgtttatgttcacaggattcctgacgttttttctgttcagcctctttgacaaccgagcagtattctctttcgtgcaacctagcaccgtgctttgtcatcagccgctttccgcaatgttcacactggtaaagcgtctgattttctaacactttcattctccttacctcccgtcactctcttcccattgctgaatctgcttttcttttgctggcgccgttagtatgattgccggcagcagcatcaccgctttaagcactcggcatcagctccatttgtctgatcttttcctcaagcacctggatagctggtgtgaggtccttgccgcccttttgttcagcaggcccgaacaaatacattcctttggatcctataacgttcgttttctcgttcaatcccaatcacccaatctatgatttaattccatccggttgccctgaatgatcaccgtgtaatacttgcacatctggtaaatccgagagcccagcgcctcgtcaacgtccagcagatcgtccgttgtgagctcagaagagatcagcagaggtttatggttcaggtagcgataattcacaactgactggatctgttcgacttgccattcagttgcccttggcttcccgtcaactggcttgaataagtcatcaatgaacagcacatctgcttttctcatggcgttcagctttgtttccagctggtcaaagtcatttttcagatcactcatgccctcaacgtaagggaagtacaggcagtgagttgatttcttcttaatgagattgttcatgatggccgttaacagatgggttttgccgctgcccggctgtcccagcagagcaatgctattggcacgctctcccttgatcttttcaaagtctttgaagtattcgaccgcacattcataggcatctttaatcatttgaggtttgccatctaatttgaagttgccaaacaacagcttttcgaacttttctgtaatgccgctggctgccatgagcttcgctattttcttttgtttcacacactcacattgtttggaatacgtcgttttccattcccgagccttatccggcgtgcaaacctttcctgcaaggtaatcatcttcaagaaccatttcatcaagtgataggctgtccaatggcttgtgttcttttctcaaccgcagctcagtgtctttgtggatgcggtagatcacaacgccgcgatccttgcactcagagcattcatattcaaccttttcttctgattcggcctgttctgtttcccaggaacgcgatcttgcttgaagacccttcatcattgcttggaacgctgtgtctatactgactgctttgtttattgccatactgttgtttctcctttctcttttggcttaatgggttggacaggatcgcctcaatgtagttcaagccaacgttgctgcctttatttctgaaagcctttttcattgcctcgatgaccttctcttcgccgtaatcatccaccatgtagccgattctttgcgcctcaatggagccgatagaacgagcgaccttattttcgaatagctcaaaagcgtttttcatttttggatcaacctcctgcgtttcttgtggtgctggtgcaagttcaggaacaggcttttcagatggttcctgctccgttacaggcgtttcaaatgagatcagcctgtattgccctgccttcctcccctgcggcttatattcaattcttttaagatcaatcagcatctttcggtgtttgatcaacgtattttcggaaatctcaatctttgcttgcagagtggtatttgaagtggtgaaccactctcgccaccctgccttattgttgatgtgcaaaagatgaaaccataatgcttgagttgtagcagacaacggattcgtttctagccaattcatgaagccgttcatttctttcaggtagttcatggctcacctacttcctttcacacagtgctgtcattccgctgatacggactaaacgtaagccaggttcatttgttctgagatagccttcaacataagcacggaacagctgcgcgcgatttggcgccccttccgtcagccatttgtaacagaaggggatgccgactttaatcaaatgggaggtcatcttcgctgatgtctacaggcttgccgtcaaaaggatcagcgtcctgcgcgcttggtttttcctcagatggttcggcatcaatgatttctggctcagacatttcgtcagtgatgtcaatgcgctctcgttcctcgttatcctcaataactgccttttgcatttcaacagagagtatcccccacttgctgagcatggattttagaacggttttgagtgccatcgcatcccagtccttgccccaaccgaagtccgacttgctaaatttctttttgtgtttctcaacttgcgcctttgtccaatagacagtttttcggaatccatttaaaagctcaaaataagcagcgtaaccaataaccgaatctgattcccgcttttcaaaatcaatatcaatttcctcggtcaacggattccacttttgcaattctccttcatgaaccggtatgcaattgatagatttatattggcccgtccgcaaagcaagctgaatgtatcctttgtaaccaagctgaaattgcgcacggcctttatacggaacgatccaggcataacctaagttcttatccactggcaaatcgagcgttgccgccaccatagccgatgaaattacactcatagggtctgccttttgaagcgtattttcactgttgtacaggctcagaattgacgctgtgaattgagacgctctttttcccagaacttcttcgaatcgattcatgactgctggagaagaaagcaggcccttcatcgttgttccctgctgttgtcctggggcactgttttgtttcttctgaatgctgtttttaagcgtttgatttgtagccatattcagctaacctccttaattccaaagcgcctgaattgcacttcttttgtgactttctcgtatacatctggaaactgctctttcaatttcttgctatcgatccgattagttgaaactgacttccagctagtttgatagtttccgatgaatccatattctgcttccttcatttcatgtttgatctggttttctaattcctttgcctgcaatgacagctcgttgatctgctctttcagctgtaaatactgctgaatacgtgttttattatcagatgtgagatcaacgactttgccgccttctgcttcggcataacgttgcttgagatattcttctgcagcactcgaaccgtcaagaaccggagcctttccgcccaagaccttttcattccaaaattcaatttcggcctgaaagatcattgcaataagctcgtcatcgcgctcaatctctttccaaacgaatttattgccgccgatcagtacagcaaaatatgcttttttatattcaggccccagcactcctagatagtgttggacctgaacaatatagctgtcaggaatctcgtcatcttcccactctttcaggttgtatgccgatgtggttttgcactccaaaatggctttttcgccaacaatcattcgatcaacgtttgccaatataaaaccgtgcttaggatgcctgagcattgcttttctccgccttacttttttgccgctacgtatctcaaactcttttgcaacgatatcttcaaggagtgaaccgaagtaggctgcctcacttcctgattcactcacaggtacttgacctgttttgtctaaccataattcaaacggtgttcgccatttgtttatgcctaaaattacagaagcatctgaaccgccgatgcctttccgtcgctcaagaagccattcgtcccgactcatgtccgctgtcgaagcgaaaacctctgcttgcatcagagcagccccacctttcttttgtaagcttccgcaccaagccgctgccattcccggtagtgatccattgaaggaaaactaaactgcgctttaccgtttttggcgaatacaattgaaccgccgacctgtctcaaacgttgctgatcctccgcacgctcgctgaacgccactttaactgctttagccatgtataaaacctccattgattttcttgaggctatctggtagaatattgatatatgagttttcagatagcctttaattaagtccactctgccaagtgggcttttttattgctcatttttaaattcaaaaccaagatgctcctttaagtaccgctcaaggttttccctcaagatgacttcaccctcagcgctatctatcacgtaatcgtcgaaaggcgttacttcatccccgaaaaaatcctttggtgtttctggctcagtcagcttgtcgtgccaattgtttagaatcatcgggttttcgatcgtcattcatattctcctttctgtaattagctatgcgttcatcccaaatcagataaagttcgctatgatttcggattctttcacaccatgctctgacctccaacgctgtcgctggtttatgaacaaagtgaaccatcatcctaagctcctgcgtaccactgataaatcaattccacgctgtttcagcctcatcgctgcatcatataagcatcccttatttgaaatccgtttaagatcctcaatgtttgctttgatactgccaaggatgtctaaagcttcctcgtagtcgccttctttcaaagagtccagtaatagttcagccaaactttcaactgaatctgatttccgttttacgacttcttcatctgacttcaaaaaatggttgagtttcatacgagcatcgccttcctttcctcttgttttgacatagcaacttgatccattaacgctttccgcgtccatttgtctgcaagctcctgcattttcagaccatgacttcgagataaagcataaaagagagtgtctacagctggaccaaggtcaagaatctctttaagatccgccatcggtagcgcctcaatacggccggggcgttcattcgccaaccagagcgcgatattttcagcagcctcaagggattcctttgtctgtttcataaaattgatcagggctttactggggctgacgttcaacgccggatcgactggggctgttgccctcggatgaagccggaacaagtaatgtacaaggtcaatgtgctcataagcgccgcatatctcaaaccatttgatgcaaagttcaggcgttagtgtggtcaggccattttcaacgtctgatacataccgttgatctttgccgccaagtaactgccctaattgaaattgagtaaatcccattgtctttctaacctctctcataatttttggtaaattatcgagtttatacgggttgttcgacatatgttcgcctcctgtttcacggggaattatttggtaaaatttaagtaatgaaggaactagctggcttgctgttttttcagcttattgatgatgaaggcttgtcccttcggagtgatgcgcattgtcagccaggatttcggcgtcccgtttacttggcgcaccccctgtgcgatctcaaagaaacctcgctcgatgtattcctggtatggctcattcttgttggccatgatcatcttccattcgcgcagcttctgaaacagtcgcttttcaccaatcatgatgccgtttttcgaagcaagctttgccagttctctcacaagcaatgatttttcggccgccatgcaactctgtgcaaagttgaccaatggttcctgaatcttcaatgcttgttcaagttgctgccgttcttcctgctcgctgatccatcgctttgcccggctgactggatcttcgatcatgtaggacggttgagtcattttttgaagctcggcttccatccggttaaattcagcaatgtatttttctttgaacactgctgcttttgcacccgtataaccaaaaaccaaaaatgcgagtccatcacgtttgatcagatattttttcaatgatcgtcctgttggatcttcatattcactcaacgaaaaatttcgttcagtaaaatctttagagcaattcagtgtttcaatgctttttattacatcggcgtgtcgttttccgaatacctcagccactgttaggctgtctgttacggcttggttgccttcaataaaaacaatttgattcatgctgttacctccttgcttgtccaccaaaaaaaggtgaagcagataattaagcgtgaagccttaattcttttttagaagtgaagtacggctcaagagctttacggaaacactcttctctgtccatcgttccgtaatattctttgcccatcttgatgtttgttgtttttttcttagtttgtttcgccatgtgatcacctcacgtcagtgtattcgtgttggacggttggactaaccaagaaattaagcagattcaagatccccattcttcatttcgtggcattcttcttcaaaaaaaagagtccaatcaaaatctaaaatgtttgcgatcttttttgcgacatgaggtctgacattcctttcgccagtctcaatggcaccataagttgatcttgcaatgccaactttgatggcaagttgttcttgcgttaaattggcatcttcacgtttttttctgagccagtatttcaattaggatgcctcctttcgttctacatatcgtggcttatgaatacatattaaaccacgatatgtagaatgtcaaacctttttattaaaaaacacgtaatattttcttcatttcgtggcatgtcgtttaattccacaaaatgtagagttataatgaatttagaatttacctttaaaagttagtaggtgatattatggcgattaaacataggctagtcgaattgaggaaaaagcaagggcctcatgtgaagcaagaagatgtggctaaagctttaggtatagcacgctccacttacggtgcttatgaacaagggaaacgcgaaccggaccacgctactctaataaagatagctgattattatggagtgactatagattacctactaagagatgagccagagaatatgaaaaatgaaatcttcaacgaacaagcaagaaagattcttgaagatcctgatactctggtagctgctgctgatggaaagataacagcttcaattttagaggcagctcaaagaattattgctgagcaattaaaatcaggtagacaacccggagatataaaaaacgggaacaaaaaataattacataacgatcgctttatctttatttattattattgtttagtttagtttagtttaattaatgctgaacacttcgcctcaaaatttgaggtaaactattcagttgaaaccatttcaacctcaatttttgaggtgatccatgaggttatttctgcattcaaccgcaaattttgaggtaaaacattcagggtttttcactcagattttagagagaaaaagtaaaaaaatcctttatttagacgatacaaagaaagagattgcacttcattataaaaggggaaattacaattgaaaaaatggttattaggtattggagcattgactcttagtttttctttagctgcatgtagttctgactcttcaagtagtaatgaaaaatcttcttcaagcaagacaagctcacttagtgctgaggaccagtttaaaaaagatgcaaaatcatatgcctatgaaaaagtaaatagcgccggcattaagaaagggacaaaaattgtcattgaaggcgatgttacttatgcagataacgtcaatgatgatggggatacagtttctaaaaatgttgagtttactgtaagtaaaaatagcgatggatctgaagtttacacagtaagcaataaaagcgctgataagttcaaactaaacgatacggttaaaatttatggtacatatgaaggcagagctgaaggaagtgcccttcctaaagtgaaagccgtttacgtcgataaaattgataaagaaaaagagcaagctaaacaagatgctgcactaaaagaacagtttgaaaaaactggcgaaggtgatattgaaggactgggccacgttaaagatatcggcgttggatataacgacgaagtcggaattgacggtaaagacactcctataaaacctgttacgatgggcagcatgaagctttatattaacagtgtcgacgttctcgaaattcaaccagatgatgatgcaaaatcactttattttaatgatcaagataaggttcgggctattgttgtcgatatgaaggccgaaaacacttcttctaaggacgtaacgtttgaccctaaccaagctgttattgttacaaatacaggagaacagcttgaatctgaaatgggattaatgggtgaagtaggcggagacttcttagggaaagttaaaaaagaaggccaggcatggtggatacttaaagataattcaaaagatatcactagtttgaaaatgattatttctcctccaagtgatgcaaaaacctatgatgatttaggaagcgagaaaagactagattttgatatcttgagttttgaagaagctaagaaaaaagattcaaattaaattgagcccctaaagggggcttttcttttcgctaaaaagagaacatacgtttgttcgccttcgacaaaataggtgataagatacaataaagcccatgataaaagtcacatctttggttatttaagggaggtttcatctttgagatacactaacagccatttagaagattggattgaacagctttacagggagatcaatattacaaagccacatgagattaattttgatagaattgctcaggccttggacatcttaattgtttacaatccggaaacgagttttgctctgcgattcaacggcatgtatacaatttctttagattcacgaaagacacgacaggaacagtggctggattttgctcatgaggtttgccatgattttagacacatgaacgatgataagatcatgcccgcttcgtggaaacgttatttagagtaccaggccaattattttgcttatcacttttgtatacctactttcatgctccgagcaatggacatcccccgtaatctatacgacgcagttcaagtcattgccgatgccttcaaggttccagagtcatttgcgatgacccgcatcaatatgtacttcaataaaaaacgactcatcatataaaaaagagcctctaaagggctctaagtttgcgaccggtatgcataccatttgaaatatggtttcgaacggttttctcactgataaatagctcgcttgcaatctcctttgttgtcttatcttgaacgagcaattcgaacacttctctttctcttttcgttagcagcggcttcgattgaaattctttctccttcaagtattgtaaccctccttgctaaggtgagagcgaatcagaaacgaatgggttttgatatagtcgagatatcatatgtaagaagggcgcaggaggtgacgtttacaagataattagtttatcgtgtatgaagaagcgtttctttctcctcatctgtccagctgacagctttgccgctttcctttgagacttgaaccatcacgactgccccggtgaagcagggttcgccttcgaggttctctccgagatagtgcaaggtaagagatgaactgccgactgcgcttgttttcacatagatgcgcaactcttcataaggcatgacttggcgcaaataatcgcattgctggcttgccacgactgtcatggtctgtttgttttcactcatcatattcagctttttaaaataagaaatccgcgcctcctcaaaatatataaaaggggttacattattcatatgcccaaacatgtctgtctcggaaaatcttacggatacctcattgaaaaaagaaaaggatgttttccattcttgaaacggcatatcaatataagcgggaagcttcatcttttttcatctccttattgtttaaaaaaacctctcccatgcggaagaggttttttcttcttatactctgtcgcttccgaagaaattgcggaacgcttgtaagtttgtatctctattcaaggctgcaatcgaagtggtaagcggaatccccttcggacaggattgaacacagttttgcgagttaccgcaatctgcaaggccgccttcatccattaatgcttctaatcgttcagatttattcatggcgcctgtcggatgcgcgttaaacaggcggacttgcgacatcggtgcaggccccatgaacttcgatttgctgttcacattcgggcaagcttcgaggcagacgccgcatgtcatgcattttgataattcatatgcccattgacggcgtttttctggcattctcggccccggtcctaaatcgtacgtaccatcaatcggtatccatgctttaacttttttcaatgaatcaaacattctgctgcgatcaacctgcaaatcacgaacgactgggaatgttttcattggttttaaacggatcggctgttcaagctggtcaataagcgccgtgcaagactggcggggttttccgtttatgaccattgaacatgcgccgcatacttcctcaagacagttcatatcccatgtgacaggggttgtcttctcacctttgacattaaccggattccggcggatttccatcagagcggaaatgacgttcagattcgggcggtatggaatctcaaattcttcatcataaggcgtgctgtcagctgtatcttgacgtgtgataataaatcgtatggttttttgttcactcatgattatttcgccaccttcttcttcgagtaatcccgtttccgaggcgttatcagtgatacatcgacatcctgatactcaaattccggcgcttcatacgggcttacatgtttagccattgttgttttgagccattcatcatcattacgttcaggataatccggtttataatgggcgccccggctttcattacggttgtatgcgccaagggtaatcaccctagcaagctgaagcatgtttgagaactggcgtgtgaacatcgctccctggttgctccattttgtcgtgtcattgatgttgatctttttgaagcgctccattaactcctgaattttgtcatccgttttcaaaagcttgtcattatggcggacaaccgttacgttcgccgtcatccactcaccgagctctttgtgaagaacataggcattttcggttccgtccatactcataatatcagcccatttttcttcttctttcttaacgtgagcgtcgaataaagatgaagacatgtcttccgctgaagattctaagccgtttacatatttcaccgcattcggaccggccaccatgcctccgtaaatcgcagacagcagggagttcgctcccaagcggttgccgccgtgcatagaataatcacattccccagccgcaaacagtccagggatgtttgtcatttgatcgtaatctacccataaaccgcccatagaataatggaccgccgggaagattttcattgggagcttacgcgggtcgtctcccatgaatttctcataaatctcaatgatgccgccaagcttaatatcaagctctttcggatctttatgagacagatcgagatataccatgttttcaccgttaatgccgagcttctggttcacacacacatcaaatatttcgcgtgtcgcaatatcacgcggcaccaggtttccgtatgccggatatttttcctccaggaaataccatggtttgccgtctttatatgtccacacgcgcccgccttcaccacgcgctgattcactcatcagtcttaatttgtcatcgcccggtatggctgtcgggtggatttgaatgaattctccgtttgcataatacgctccctgctgataaacgattgatgcagcagatcctgtattaatcatggagttcgttgattttccaaagatgattcccggtccgcccgtcgccataatgacagcgtctgaacggaaggattcaatttgcatgtttgtcaggttttgtgcaacaattccacggcaggttctgtcatcatctaaaacagcgccaaggaattcccagccttcgtattttgtgaccagacccgcaacttcgtatctgcgcacttgctcgtccagtgcgtaaagcagctgctgtcccgtcgtcgcaccagcataagcagttctgtggtgctgtgtacccccgaatcggcggaaatcaagcaggccttcaggcgtccggttaaacatgacgcccatccggtctaataagtggatgattgaaggcgccgcttcacacatcgccttgaccggcggctggttggcaagaaagtctcccccgtataccgtgtcatcaaaatgttcccacggagagtcaccttccccttttgtattgaccgctccgtttatgccgccttgcgcacaaaccgaatgagaacgtttgacaggaacgatggaaaacaacttaaccgccattcctgattccgctgctttaattgtcgccatgaggccggcaagacccccgccgactacgataatgcttgattgactcatgatagcccctctccctctagtaatctagtactcttaaacaaatgcgaaaatcgcttttaagcctacgtatgacagtgcaacaaaaataatcagcgtaacgtatgtcgaaattctttgagaacgaggcgttaccgtgatgccccatgtaacagcgaaagaccataaaccgttcgagaagtggaaaattgttgataaaacaccgacaatgtaaaaaccaagcatagccggagagctcaaaatattcgccatcatgtcgaaattgacctcagcgcccatttgtgcggcaatgcgggtttcccacacgtgccagctgacgaaaatgagggtgatgataccggttacacgctgcaggacgaatagccagtttctcatgtagctgtattgacctgcgttatttttcgcagtaaacgctatgtacacaccataaactgcatgataaattaatggtaagaagataataaaaatttccaaggcatacctgaaaggcagactatccataaaatgagcagcgctattgaatgcttcagcgccccttgcggcaaactggttgacgactaaatgctgaataagaaagatgccgaccggtatgacgccaagcaaggaatgcaatcttcgaaaataaaactctctgttcccagacattactttaccccctgtttgataagtgcgaaatgtgctaaatctcttcccccacttctttcaattgtaagcactttattaagatttattgacaatttcattttactcctccctcaaaagggcgtcaagaaaacgcgtacataaattataattttccgaattggttagttgattgaaaaattttattttatcaatatatatttcttacttaatttttcataagaattacaggatcattctgtaatcctcccccctgtttgagctataatatacgcaggagagaggggagacagatatgaagtctaaatttgaagcatctattgacaacctaaaagaaattgaaatgaacgcctatgcctacgaactaatacgagagatcgttctcccagatatgcttggccaagattactcttccatgatgtattgggcaggaaaacatctcgcccgtaagtttcctcttgaatcatgggaggaatttccggccttctttgaagaagcgggctggggaaccctcaccaacgtaagcgctaaaaaacaggagcttgaatttgaacttgaagggccgatcatttccaaccggcttaaacatcagaaagaaccttgctttcagctggaggctggttttatcgctgaacaaattcaattgatgaatgatcagattgccgaatcatatgaacaagtgaaaaagagagcggataaagtggttctgactgtgaaatgggatatgaaagacccagtgtaatcaaaaaggcggtgactgcatagtcccgcctttttgattgtcattacacagctgaagggtgttttgaaagctcaaatgcatcgtgaagcgactcgactgctttcaccatgtcattttcgcttacgactgttgacactttgatttcagatgtgctgaccattttgattaaaatgtttttttgcgccagtacagcaaacatttcagccgctacaccgggatttgagaccatgccggatccaacaatggatactttagccaatttgctttctgtctcgattttctcaaattccagcgcgtctttatactcttcaagcaccgcaacggtttggtctgcatcttctgttttgacagagaaggaaattccagtcttgtcctcggcctgcgtttggataatgatatccacgtttatgtttcttttggcaagtgtcgtaaaaatagtagacaaagttgtcaagccgctagtcagcccgtaaatggttactcttgtgatttgatcttcaaatgcaatgcctctgacaattaaattctgttccatggatgattcctcctcaattaatgttcccgcttcggtttctgtacttgaacgcacttctaacggcacttggtaatttttcgcgaactcaactgctctcggatgaagaacgccggcgcctaaattggcaagctcaagcatttcatcgtatgagatgcccgcaagttttctcgctgatttcacatagcgcggatcggttgtaaacacacctggcacgtctgtgtatatgtcacatttatcagcttttaaagcggcagccaaagcaactgctgttgtatctgaaccgccccggcccaatgtcgtaatttcacaatcctctgtcattccttggaagcctgcaacaatgacaatttttcctttttcaagctggtctgctaaaaccgaagtgtcgatatctgtaattctggcgtttccgtgaatggcctccgtacggattcccgcctgccagccagtataagacacagcgtcatagcctttttcctgcaatgccattgaaaggagtgaaatcgtgacctgctcgcctgtcgccagcagcatatccatttcgcgtttgctcggctggtcagaaatagcttttgcaaggctgaccaattcgtcagtggattttcccattgctgaaacgacgacaacgacttgatggcctttctgtttttctgcaattgcgcggtttgccgcattttgaattttttcgactgagccgacggaagtgcctccgaatttttgtacaataagacccatgtattaccaccctttacattttggttcgtgcgggtgaggagaaagagcgctttgtccacaataaaaaaagcaatgagaggaatactctcattgcttatcaattaatcatcataaatgattatgaacaacgagatagccctccaagaaaatgatttcttgacagccttacatttattcaatgcacggccagcaaataataccgatggggttttatttgcttcggcgacgctcccctttcagcctttttcacagaatccatctttctccaaaggcatactcttgaagttcgcacctctatcttcaccatataacacgatctaactatgaaattagttcacattttatcagatcttatttaaaaggacaacattatttttgcaatttgtcgtaaaggagctgagccgccgctgcgggaacaccggcttttttgatgtcctcaaggcttgcttccttcatttttttaacggaaccgaaatgctttaacagcattttctttcttttctctccgatacccgggatgtcgtccaaaacggattgaaacgcgctttttccgcggatttgcctgtgaaaactgattgcaaaacggtgcacctcgtcctgaatgcgctgcaggaggtaaaattcctggctgtttcgttccagatacaccacctccagcggatcaccgatcagtaaatttgaggttctgtgtttttcatctttcgctaaaccggcgatcgggatatccaagccgagttcattttcaatgacatcccttgctgcgttgatctgcccttttcctccgtcaatgataatcagatcgggcagcggcagattctcacgaagcactctcgtatagcgtcttctgacaacctctctcatagaaccgtaatcatccggccctgtaacagttttgattttatatttgcggtattcctttttgtatggtttgccatcgataaacacaatcatcgcggaaaccgggtttgtcccctgtatatttgagttatcaaacgcttcaattctgtgcggcgtataaatatttaatgcctcacctagtttctgcactgccccgattgaacgctcctcgtcccgttcgattaaagagaatttttctttcaatgcgattttcgcatttttatgggcaagcatgagcagttcttttttcgggccttttttcggctggtgaacgtttgtttccagcagctgctcgatcatagattgatctacgctgtccggaactaaaatctccttcggaaggaagtggttgttttttgaatagaactgcccgatgaacgtgaggaactcttcatctgcttcctgataaagcgggaacatgctgacatcgcgttcaatgagctttccttggcggatgaaaaagacctgcacgcacatccagcccttatcgtacgcgtacgcgaacacatcacggtcgactagatcgttcatcgtcattttttgtttttccatcgttgattcaatatgggccatttggtcacgaagctcttttgctcgttcaaactcaagattctcagcagcttcatgcattttctcttcaagctcttttttgacctcattatagccgccccttaagaaacgtgtaatgctttcaaccagctctctgttcgtctcttcggaaatatcctttacacacggagcgaggcattggcccagatgatagtaaaggcacactctgtccgggagcttggagcattttctgagaggatacagacggtcgagcagtttttttgtttcccttgctgcctgtacattcggatacggcccgaaatagcgccctttgtcttttttgacattgcgggtgacaatcagccttgggtggcgttcatgggtgagttttatgaaaggataggttttgtcgtctttgagcatgacgttgtatttcggatcatgctttttgatcagattcatttctaaaataagcgcttcaagattggaggacgtcacgatatattcaaaatcctcgatttccgtcacaagcctttgggttttcgcgtcgtgagaaccggtgaagtaggagcgcactctgtttttcagcacttttgctttccctacgtagatcacagtctgctgccggtccttcatgagataacaacccggttgatcaggaaggagggcgagtttttctttcagttgtttgttcatatgttacccttccttatgtttaatcctttatttccagtttaacacgaacgtttgtttttctctatggttcacaattggcgaataaaaaaagcgatccctcaatcggaatcgctctggcatgtaagcagcggaaaattaaagatgtttgtttacaagctcttgaagcgcttcttttggtttgaagccgactgaagtttcaactacttcgccgtcttttaacacaagaagagtcgggatgctcataacgccgtattttccggcagtttcttggttttcgtctacatcgatttttacgattttcagtttgtctcccatttcttgatccaattcttcaagaacaggtgcaatcattttacaaggtccgcaccaaggagcccagaagtctgccagtacgacgccttcgcttgtttcagctgagaaagattgatcagttgcttttacgatagccattattgaattcctccaatgtgaaatgatgatttttagtatagcatctcccattcgttcacgctattttaatgcttacaaattattttttcctgatcacagccggtttactcatttttatatggttgaatgggatatgctctttttttaaaacacaaatctgataatggccccaatcactacaattgccccaataatcattaaaatggtacgaagcataagatcacatctcctcttcactgtcatgtactttaccatgccctgccggagctgttttaaaacctgaaaaagagcgccggcatgaagctccggcgctcttgcgcgattaagaatcagcacgcagcgtaagcaagacgactgacattggcgggagttttactttcagtttgtttttgctgagcgtgtattgcctgaaggattccggtttgacatgatgaggatcgtcaaacgtgttatgcgcattcattttttctgccgtaagaatgactccggaatggtccgctgccttgtgtaggcccctcagctcgatttccgcctccgctttgttttggtgatcgatgttgcaaattgtgatattgatatcgccttcagtttgtttcgacgctgaaatgctgatttgcggaagcgtttcaccgttccattcatagtcggcagacattgtctctgtggctaaaagagaagcgtcctggtgcaccttaaacatattgaatacatggtacgtcggtgtcaaaagcatccgctctccctcagtcaaaatcatcgcttgaagaacatttactgtttgggcgatgttggccatttgcacccggcggcaatgctgatggaaaatgtggaaatgagaagccgccaccagtgcatcacgaatggtgttttgctgatataagaaaccgggattcgtgcctggctcgggatcaaaccacgtgccccattcatcaataatcagcccgacccgctgctccggatcgtaccggtccataatcgtgccgtgtttttgaatcaattcatcgatgtatttggcttttttcatcgtaataaaccattcatcttccgtgaattctgtggctgatcctttgcccttccagaaatcccccggaatcgtgtaataatgaagactcaacccgtccatcaggccagcggcttttttcataagcacgtccgtccaattaaaatcatccacatttgcgccgcctgcaattttataaatgtcattcccgctgtaattgcggacataagtctgaaaacgccggtacagatctgcgtagtattcgggatgcatgttgccgccgcagccccagttttcattgcccacgccgaaatatttcagcttccaaggctcttctcttccattttgctttctccagtctgacatcggcgtgccttcttcaaatgtcatatactcaatccactccgccatttcctgaacggttccgcttccgacattgccgcaaatatatggctcgcattcaagcagctcgcaaagcatcataaattcatgcgttccgaattcatttgattcaattgtaccgccccagtgagtgttcagcattgtcttacggtcaccgacaccgtttgcccaatggtattcgtccgcaaaacacccgcctggccacctgaggacagggatgtgcagctgtttgagcgcctccagcacgtcctttcgtatcccgttgatattggggatgtctgagtccgttccgacccagatcccctcataaatccctcttcctaaatgctcagcaaaatgaccgtatatatttttgttaattgttccttttacgatatctgtttgaatcactgcttgatgttcagacatgcctctgatcattcctttcatacggatatgaaaagcaccacagtcaaatatgtgatctgtcttttgcctgaggagtcagcatgaatgtaagcgcttttaaagtaaccatattatatatgttcgtacatgtcaacgacattttctattgtttttatatttgtacgtatgtatttataaatatgaaaaaatcccgaacttttaaagtccgggatttcctttatgagtgtatattcaattgtttgaattcctcagttaataacgggacaacttcaaataaatcaccgacgatgccgtaatccgctattttaaagatatcggcttcggggtctttattgatggcgacgatcaccttgctgtttgacatgccggccaaatgctggatggcgccggaaatgccgcatgcaatgtacaaatccggagtgacgactttcccggtctgcccgatttggagagcgtaatcgcaataatcagcgtcacatgccccgcgagaagccccgactgcggcccctagcacctctgcaagctcctgcagaggctgaaatccctccttgcttttgactcctcggccgcccgcaacgataatttttgcttcggagagatcaacgccgtcagctgtttttttcacgacctcttggataacagtgcggaggtcagtaagagaaacatcaatgcttttgatgctccccgatctgctggtgtctttttctgaagcttgaatgttattggggcgaattgttgcaaagatcatcggatcggttgaaatgacgcgttcaaaagctttccccgagtaaatcggccgtgtgaacacaacattccctccggtaacgcttacatctatagcatcagaaattaagcctgtttgcagccgggcagcaagcttcggtgaaagatccttgcccattgccgtatgcccgaagatgactgaatcaggattttcttgctcgataacacctctcatgacctggctgtacccgtctgccgtgtatgttttcagcttcgggtcctcagcggtaagaactttatctgctccgtaatgaataagctcttgtgcaatgctttgtacattttcaccgatgagaacaccgatgacttccccatctcctgaaatggttcttcctgcagctattgcttcaaaggtgacattccgcaattccccatcgcgtatttctccaagcacgatcactttttttcccattctaacatccccctgtttctttgaatgtccaagctttaaatgactttagcttcgctgcggagcaatgaaacaagctcttttgcctgttcagcaggctcaccttggagaagcttcccggcttcttttttcggcggcagaaaacgttcaatggttttcagctttggttcagcatcctcttcgtccaggtcaagatcatcaagttcaagctcttcaagcggctttttcttagccttcataattcccggaagcgatggatagcgcggctcgtttaagccctgctgagctgtgacaagcaatgggagcgtcgttttgattttttcaacatccccttcgacgtccctttctgcttctgcatcagtgccgttgatttcgagtttggtgatcgtagtgatacacggaatgtccagcagctcggcaagccgaggcgccacttgtcctgatcctccgtcaatggcaacatttccgccgagaatcaaatcaaactcctgatccttcatatagtggtataaaacttgagaaatggaatattggtcgggttcatcaagatcatcttctatgttgattaaaacagcttggtcacaacccatggcaagcgccgtacgcaattctttctccgcttcttcaccgccgaccgtgacagcggtgatcgtgccgccatgcttttccttcagctggatggcttcttctatcgcgtactcatcatatggattaatgatccattccgctccgtcatcctgaatctttcctgtttcaatgacgattttttcttctgtgtcaaacgtccgtttcatcagtacaaatagattcatgatcatatccccttttattcgcctttgaactgaggctttcttttttcgagaaatgcctggatgccttccttggcgtcctctgactcaaatgcttccccaaatcgctttgcttcaagctttaagctgccttcataggaatacaccttgttggaataaagaagttcaagcaaagatgccagcgtttgcgggcttttctctgcaaacttagcggcaagtgcttttgctttttcaatcacttctgcctcatctttcgctccaattgaaacaagtccgagatcaagcgcttcttttccggatatcggttctcctgatccgatgagctccagtgctttggctgtaccgacatatctcggaaggcgctgtgtccccgcaaaacctggaatgataccgagattaagctccgggagccccagcttagcatcttctgccgcgattctgatgtgacaggccattgcaagctccagcccgcctccgagagcagcgccgtgaatcgctgcgataatcggttttggaaaactttcgattctctccattaactgctggccgcgctcagcgagcaatgaggaatcctcattgcctttaagcgatgtaaattctttaatatcagcgccggctgagaaaaatcttccctcgccgtgaatgataatgcttcgtacgcctgcatctgtctcacattgatcaagacaggaagacagctcttctaatatccggcttgaaagcgcgtttgccggcggattgtgaatcgtcaagactgccacaaattgatcaaccgcaagtgaaattgcattcataggacagaactcctttacttattgtgaattccggataccaataattctaaaacgctgtttgaaagcgcaacgagatcgtacttttggtcattcatcacccaagttgtcacagtttcgtcaatcgttccaaaaatcatctgccgggcgaggcggacatcgaggccttcttttatttcgcctgattgtataccttccgtcaaaatgccatccaaaatatttaagtagccttttaatatttcgttgattttttggcgcagctccaagttggattggcggagctcaagctgcgtgacaatcgcgagattatggtcacccgctaaaagggaaaaatgctttgaaatcacaagcgccaatttctctttcgctgttgctttttctttaatgtcctcttccatccgctcaataaattgacccattttttctttgaaaagagaaattaaaatatcttctttgtttttaaaatagagatagatggtgccgtccgctactccggcttgtttggcaattttggatacctgtgactggtggtagccgttttctgcaatgacttctactgctgcatcaataatctgcatatactttggccgtttttgcttcaatgttcatcgttccttcctacagaaatgaatgactattcattcataatttcatgataagaaggattttcaggtttgtcaagtttattcataggcgttctctttttttatttgatatgatgattttcggtttcttcttcaagtaaacgccttcttaaaatttttcccaccgccgttttcggcagctcttttctgaactcataggctttgggcaccttatagggagctagtcgagatctcgcaaaggcatccagttcttctgcatcggcttttgcgcctttctttaatacgacaaatgcttttactgtttctcccctgtaggaatcgggaacgcctgcaacaacaatttcctggatggcttcatgttcataaagcgcttcttctacctcacgcgggtaaatattgtaaccgccggcaatgatgatatccttcttcctgtcagcaatatagaaaaagccttcttcatccatatagcccatgtccccggtgaacagccaaccatctctcagcactgcggcggtttcctctggtttattccagtatcctttcatgacttgcggaccttttacaatgatttctccatgctcatacggagcggcaagctcacccgtctcttcagaatagatcgcagcgtccgtactcggccaaggacagccgatactgcccggcttgttttttccccagataaagttggcgtgcgtcactggggatgcctcagacaaaccatagccttccacaagctttccgccagtcaccttttcaaatttctgctttacctccacggggagcgcggctgatccgctaagacagcttttaatggatgacagatcataatgctgcaattcggggtgatgcaaaaggccaatgtaaattgtcggtgcgccaggaaagagcgtcggtttgtgtttgtcgatgattttcagtgtttcgagcggatcaaacttaggaagaagaatcatttcgaagcctagtttaatcgaatagttcatgactgccgtcagtccgtagacatgaaaaaatggaacgatgcccagcactttttcagcgccttctttcacgtcatacatccaagcggcgcacatttcagtatttgccaaaatattttggtgcgtgagcatgaccccttttggagctccggttgttcctccggtatactggaggacagcgatatcatgctcaggatcgatcttcgggattgtcaggagttcagttttttcctgcttcatactggaagcgaacgtgtgaatgttagctgttttgtcaaagtcgatatgcactttttgtttttgcgtcagcgggtaaagaatattcttcggaaaaggcaaatagtcttttacgctggttatcaaaatctggtcaactattgatagcgttttcatttttattgccttcgggaaaagcaaatctaaggtgatgattacacttacctgagcatctctaagctggtattcaagctcatgctcggtataaagcggattcgtctgcaccacgatgccaccggcaaacaagacgccataataagaaatcactgtttgcgggcaattgggcagcataacagccactctgtctcctttttgcaggccattgcactgcaaaaaagctgcaagtttaagagcatccgtcagaatgtcatgaaaggtgagtttttttccataaaacgatattgcggttttatcagggaatcgtgcggcggagtctgtcaggatggattgcagggttttattcggcaacgggagctcatgcgggatatcgttgggatactcggcaagccacggcttttgagactgcataaaacctccccctttcgattttagagttccaccttatcattatagcagatggacggcaaaaaaaagaaaaagaaaggtaaatctttctttttctcataatatgaacagatatataagaccaattaacaaaaagattcccgccgcggcgagcagtacttttgcaagcttttccatttattctccgtccccttatattccggctgccaccacaaatgaaagcccgacagaaatgacaaatgaaataaagccgacagcccggttatcattttcgatttcctgatcaattttaaaccgcggagtcaaaaactcaaaaataaagtagctgatcagaagcataacaaacccgtaaacgccccagccgatcatttgcagcagcgaattatgctgggagatggaatgctgaaatacgtttgcgatccccaaaatttttccgccggtcgccattgccaccgcaagatttcctttttgaatctcttcccagtttttataagccgtcaccagctcaaacacagtcaaaaagaggacgaggcagagaaccgcgacactgtaatatgccgcgatttccacaagctcgttttcccaaaaatcactcatggccatactcccttttattttagttcaacaaccgtaacgcctgatcctccctcacctgcttcaccgaaacgggaacttttgacgctgcggtggtttttcagaagatcctgtacgccttttcttaaagcgccggttccttttccgtggatgattgacactcttggatatccggctaacaccgcatcatccaagtatttttcaacccggcttagggcattttcatagcgttcgccgcggagatcaagttcaagcgatacgtgatagtcctttcccttgaccgctgtaatgattttttctttttttggctccggagctgatttgataaactccagatctttttcttttactttcatctttaaaataccgatttggacattccattcattgccgcctgttttttcgagcaatgttcctttttgcccgaaagtgaggactttcacctcgtcgccaggcttaaagtcgcgtttttgcgctttcggcttctccggtttcttggacttttcaaaagccggcatagcgccttctaaccgtttcttcgcgttaatcagctcgtgatccttgaaggatttgtgttcttcttttatggagcgcaattcatgaataatgtcctcggcttctttcattgccgcttttactttttcagcagcctgctgttctgcctcttcaagcattttgtcttttttgctgttaagctcgatgatttgctgctgcagctctttatgcagtttttccgcttcttttctgattgattctgtctcagaaagctcttcttccgcacgttttttgctttgttccagcgacgcaatcatcgtatcgacttcgttatgctcggccgtcatttctgacttcgcctgcccgatgatatggtccggaagcccgaggcgttttgaaatttcgaaagcattgcttcgacccggcacaccaattaaaagtttataggtcggtgacagcgtttcgatgtcaaattcaacgctggcattcatgacgccttctctgttatagccgtacgccttcaattccggataatgcgtcgtagctaacactcgtgcattggtgcgatgcacgtcatccaagatgctcatggcgagggccgccccctcctgcggatctgtccctgcaccaagttcatcgaaaagcacaaggctgttttcattgacctgttctaaaatgccgacaatattcaccatatgggatgagaacgtacttaaactttgctcaatcgactgttcatcaccgatatcagcgaatacgtgctcaaatactgccgcttctgacccttcatctgccgggatatgaagacctgactgcgccattaaggttagcaggcctaacgttttaagggtgactgttttccccccggtgtttggccctgtgatgacaatggttgaaaaatcgcggccaagctcgatgtcattggcaacaacttgatcaggcggaagcaatggatggcgggcttttttcaaacggataaagccggtgtcgttcataatcggttttgtcgctttaaccgcttttgcatatctagcttttgcaaaaataaagtcaagcgtctgcagcacttgcaaatctagaaatagttcctctgtatactctgccgttttctctgtcagcacacgcaaaatccgttcaatttcttgcttttctttcactttcgcctgctgaagggaattgttcatatctacaatcgcctgcggttcaatgaatagtgtcgcaccagaggatgaggtgtcgtgcacaattcctccatagctggatctgtactcctgtttgaccgggatcacaaagcggtcattccgaatcgtaacaatcgtatcagacagcattttcgatgcggaagaggaacgcagcatcgactctaaccggtctctgactcttgattcgagtgttctgagctgtgtgcggattcctcttaatgtttccgatgcatgatcaagcacttctccgtgatcatcaatgcaggaattaatgtcccgctctaaatcggacagcgtgataagctgttcagcatgctgatggatcagcggaatgtcgacaccgtcttcagccatttgggtgataaaatgtttcatttgtttaactgcataaagcaggcctgagatttcagtgaattcagaaggactgagaacactgccgatttccgcccgtcttaacgctcctctgatatctacaaggccgccaaatggcgcttggcctctcagccggataatgtcagaagcttcgtctacttcatccagctgttttttgatttcgtctatagaagcagaaggcttaagctcgagaagcatttcttttccgagcgatgaagcggcatgcccaataacctgttctttcactttatgaaattcaagagctgataatactttttgctgcacgattgtgtgagcctccttacttaatcgttgcgcttcagaaatgcctctacgtctttaagcgaccgggcattcagaacgtttttcgtttccgtccatcctttgcgcgcggcagtaacgccagttttcatatcgtctaacatctcaatattatgggcatcagtattaatcaccaatgtaaccccttgttcgtttgctttcattaaatgctctgtgcgcagatcaaggcgcgcagggttggcgttgagttcaagcgccgtatttgttttcctcgcaagctcaatcagctgatcaatatcgatttcgtaaccggcccgtctgccgataaggcgcccggtcggatgtgcgataatgtcaacatgcttgtttgtcagtgccgtctcaagccgtttcataatcacgtgttccggctgattaaaactggaatgaatcgatgcaataacgatatccatttccgcaagcacatcgtcatcataatcgagcgtaccgtcaggcaggatatccatctcaacgcctttcaaaatacggaagttttcaaactctgcattcagcgcgtcaatttcttttgcctgctgcttaagtctttctgcagtaagcccgttggcgacctttaaatattgtgagtgatcggtgatcgccatgtattgatagccttttttgatgcaggcttcagccatctctctgatcgaaaatgcgccatcgctccacgttgagtgcatgtggagatcacctttgatttgcccgagctctatcagttcaatgctgtcgctgtaggtttccacttcctgtccgctttcacgaatttccggcggaatcagcggcaggccgaagtgcgcataaaattcacgttcactcggaaatgttttgatctctccggtttcaactgtctcaacgccgtattcactgatccgctcgccgcgttctttggcgatttggcgcatcttaatattgtgatcctttgatcccgtaaaatgatggagtgttgtcggaaactgctcttccgtcacaagacggaaatcgacgcttgtttcatattcaaaggaaaggatgacggacaccttcgtatctccgcttgcgattacgcttttgatgtttggcagctcaagaagctgctctcttacttcagccggatgatctgtagcaatgatataatccagatccttcaccgtttcccgcgctctgcggagacttccggcacgagaaaatttgatgatatgcgtaaattgagaaagatgctcctcaatttcccgcgcgatccggagggcgtatccgatcgggaaccgttcaggctgttttccggcttccccgagcgcctgtaatattttttcttccgattttttgccgaagcccgcaagaccctggaccttttgctgctcacaggcttccttcagagattctgcatcgtgtacgccgagctctttatacagctttgcgatttttttgccgccgagccccggcagcttcaataaaggcacgagtccttccggcacttctttctgaagcgattcgagcgtgcttgactttccttcatctatatactctttaatgacgctgtacgttccttttccaatgccggacagcgacatcatatcgtccatttctgataagcttcggtcgtcctgttccaaggctgccgccgcttttcggaaggcagatactttaaacgggttgtcccccttgagttccatatagactgcaatggtttcaagcagccggataatatcttttttatgcatatcataaccccagacgttcacatatgtttccatcatacttgaaaaaaacttctccggacaagagaagtttttttatgccccgtactgtgtccacagctcttgtaaaagccctgacaagtacggtgtatggttaatgatcacatttgcgagagacgattgtcccatcatttgctgcaacgcatctaccggcagaacggatgcgacatacagcagcacaaatgtaaataaatagacttctagaaaaccgagaacggctcccagcatctggttgatttgtttaatcaccggaatgccggctacaatactcaggaacgagccgatgattctcagtaagattttagcaatgataaataaaacgataaacgcaatcgcattatagtacgctgcttccaaattccccgtaaaaaaagaaagagccggctgtcccgctgaaaaatcgggtgcgggaatccaatgtaaatgcggtgccacgtttttatagaataaagccgcaaaggcaattgataaaataaagctcgtcaagcggataaactgcaggataaaaccgcgttttaaccccagtaaagtccccatcaggagcaagattaagatgatgatatcaagcatagttgttcaatccttttctttaagctgacgctccagtttttcacatttctcttgtaatttgacataatcgtgcaccacatttaccgctgtcagcactgcaagtttatttatatcaaggtatggatttttttcattgatttctctcattttatcatcaacaattccggcgacatacctcatatgggctctgctttcttcaccgacaatcgtgaagtgctggccgtaaatgtcaacggttgtttttgtttttttgccgtcagacaacgtttctcctccattccgcgagaatcctagttcttatcataacacgtttattaaatgaatggaaagacgagcctcccgctgttatgatacactggtatatacagcgaaaagtgtaaaaaaaggagattattacgtgtcccattcagtgataaaagtatcgttgtctgctattgaccaaatgaaaatgacgtacagcggttcacttacagcctctgttccgcagggagccgtttttcaggcaaaaccgcccggctgtaccattacagcatataaatcaggcaaggtcttgtttcaaggaaaaaacgctgcggcagaatccgcgcgctggggaacagcagagcctcaggaaaagaagaaaacggccaaaaagccggctgatccccgctatgcccctccggcagatatcgccggaatgtctgttatcggttctgacgaagtcggaaccggagattactttggcccaatgacggttgtatgcgcgtacgtcgacaaaaccatgcttcctttaatgaaggaactcggtgttaaggattctaaagatttaaaagatccgcaaatcatcgagattgcccgaaacctgatcaaaactattccatatagcctgctggttttaaaaaatgaaaagtataacagcatgcaggaaaaaggcatgagccaagggaaaatgaaagctttgctgcacaatcaggcgatcacacatttattaagaaaattggatggagtaaagcctgaagccattttgattgaccaattcgctgagccaggcgtctacttcaatcatttaaagggcagagacattgtgaaggagcggacctattttagcacaaaagctgaaggtattcacctggctgtcgctgctgcttcaatcattgcaagatattcatttttaatggaaatggataaactatcacgcgcggcaggaatgacgcttccaaaaggggccggtccgcacgtcgatgaagcggccgccaagctgatcctcaaaaaaggggcatctgcactcagaacctttacaaaactccatttcgccaatacgcaaaaagcgcagcgccttgctgataaaaaacgttcatagaaaaaagcttgcagatttctctgcaagcttttttctcagcctcttaaaacagcttgatatgtgtcttctaacgctttcagcactttgctgtgcgcctttgtcacttcttcttcagtcagtgtttgttcagggttgacatactggagtgagaaagcgactgacttcttgccttcctccatatgttcgccttcgtatacgtcaaagacggttacctctttcagaagcttgccgccagcctctttaatgacgctctcgagctgtccgcttgtaacggttttatctgttacaagggcgatatcacgtgtcacagacggatatttcggaatcgccgtgtaaacaagcggtgctgtttctgctgcgagcaacgcatgaagatcgagctcaaatacgtatgtttcctttatatccagttctttttccaatgaagggtggacttggccgatgaagccgatcagagaaccattcaataaaatgttcgctgttctgcccggatgcagctgtttgcgttcagactgtacaaattcaatgctgtctaggacgttgagtttgtctaacagcccttccacaattcctttgacaacaaagaaatcaactggtttcttttcaccctgccatagctgcttgcgccataatccggtaacagctcctgctacgcgttctgtttcaacaggttttgtgtcctcttccttcgttaggaaaacggagccaacttcgtacagtgcaactgagtcagtctgcctcgcaaggttgtaagaaacagaatcaagcagattcggaacaagactgtgtctgagaatgcttctttcttcactcattggaagcgcaagcacagtattcagtgatttttcaatcgcaaacgctgccgctttcttctcgtttgtcagtgagtaagtgatggcctgtgataagcctgcgccttcaaggaagcgtctgactttacggcgttttgcctgatatggcgttaatccgcctgtagttcccgctgtctcaggaagcgtagacggaatgttatcgtagccgtacagtcttgccgcttcttcaattaaatcctcttctattgtaatgtcgccgcggcgtgatgggacagtcacaacgagaagttcatccgcttcaccgaccgtaaaaccgagacgtttataaatgctgatcagttcttctttactgatcgtcaggcctagaacgctgctcactttgtcagcagatacgtgaatgttatttgcttcgattgtcaggtgatcttcctcaactgttccagcaagcacctcaccgccggcatacagatggatcatctgcgcagcccgttctgctgcaagacgtacgcgcgccggatcaattcctttttcaaatcttacgcttgattcacttctcaaaccaaggtctttggaagccttgcgaaccgtctgcccattgaaatacgcagcctcaagcaaaatcgttttcgtatcttcctgaacctctgactctgctcctcccatgacacccgcaacggcctgcgctttcgttccgtttgtaatgacaaggtgatcggcggacagcttacgttcttgatcatcaagagttacgatcatttcattctcagctgcttttcttactacgacttccttagagccaaatctgtcataatcaaacgcatgaagcggctgtccgtattccaacaggacaaaatttgtgatgtcaacgacgttgttgtgcggacgaatgcctgcattcatcagctttgtctgcatccaaagcggtgacggagcaatcgtgacatttttaatgatttttgcagtgtacagcgggttcgcttcttgatcttcaattttgactgaaatgtaatcagacgcttgttctgaagcagccgggtaatccgtttgcggaagctttacctcagtgtctaaaatcgcggcaacctcgtaagcaacaccaagcatgttcatggcatccgcgcggtttggcgttaaacccagctcaagaatcgcatcgtcaagctgtaaagccgctaaggcatcgcttcctgtttcagcgtcattagggaatacgaaaatgccttctgcatactccttcgccacaagtttgctttcgataccaagctcctgtaaggaacagatcatgccatttgattcttcaccgcgaagcttggcttttttgattttgaaattgcccggcagcaccgctccgactgttgcaactgcgactttttgtcccttatccacattcggcgcgccgcaaatgatttgtacaggggcttcagctccgatatccacaaggcacttattcagcttatcagcattcgggtgctgctcgcgctccagcacatggccgatgacaacacctttgatgccttctcctttgtattcaattccttcaacctcaataccggctcttgtaattttttcagcaagaacagccgggtccatgccttttaaatcaacataatcctctaaccatttataagaaacaaacatccttgcatcctcctcttacgcctgtttaaactgcgaaataaatctgacatcgtttgtatagaagtggcggatatcatcaatgccgtatttcagcatcgcgatgcgctcaacacccattccgaatgcgaagccctgatattccttcggatcaaagccagccattttaagcacgttcgggtgaaccattccggcaccgaggatttcaatccagcctgttcctttacatactgagcagccgttcccaccacatttaaagcatgtcacatccacttctactgaaggctcagtaaacgggaagaagcttgggcggagtctgatttcgcggtcttgtccgaacatttttttcgcaacaagttcaagcgttccttttaaatcactcatgctgatgtttttgtcaacgacaagcccttcaatttgcataaattggtgagagtgcgtcgcatcatcgttatcacggcgatatactttacccgggcaaatgattttaacgggacctttgccttcatgcttttccatcgtccgtgtttggacaggggaagtttgcgttctcatcaaagtctcctctgtgatgtaaaagctgtcctgcatatcgcgcgcagggtgttctttcggaagattgagcgattcgaagttgtaataatccgtttcaacctctggcccttcctcgactgtgtagcccataccgataaataaatcttcaatttcttcaatgacaacagtgagcggatggcggccgccgactgcaacagggttccccggcagcgtgacgtcaattgtctgtcctgcaagcttctgtttcatttcctcttcttcaagcttctcgtttttgtcagcaatcgcattggcaatacgctcccttacttcgttcgcgagcgcccccatttttggacgttcctcagcagaaagcttgcccattccgcgcagcacttctgtaatcggccctttttttccgagatattgcacccgaatatcattgacaatcttcaatgagcttgccgcttctacttgttctaaagcttcttgttccagctgttttagcttttcttccattttgcatcctccttttatgtaaacaaaccgtcatatgtctttggaaaataaaaaaaacccgtcccttttacaagggacgagttgtggccgcggtaccacccttatttcagacagactgatgctgtcgtcagcttcattgacataacggaatcagattccggttcacctttacgcgcagtgtacgcggtcccggcgacaactcaagaggtgaagccaatttccggctgcgttaaaaatgctctcagtcagcggcattttctccctggaaagcagttgatcagaaattgaggtcctctgtcacggtttttgaaatattatgttctattatagagaaatccaacgcttggcgcaacactatcctcgcaagtgatacacgaggatggcagccgcaaccgcaacgtttagtgattcagcctgtccgtaaagcggcacgtacaggttcaaatccgttttttccagcaatgcagcatccacccctgcaccttcatttcctacaatgagcgcaaaggattcagactgaggaatctcctggtaaggcgctccgttttgcagcgccgtgccgtatacttttacgccctctgccttcaattcgtccacatatgaaggcaggtttcttctcacaacaggaatatggaagtgagatccttgagcagatcgcagtgtttttccgttaaaggcgtccgccgtgccgtcaccgagtacaaccgcatccaaaccggccgcatcagccgttcgaatcattgtgccaaggtttcccggatcttgaacagcgtcaatcagcagcaccttgcgtgccgttgccagcttttcttcaggcatatggcacacagcggcaatctgctgcggcgtttcggtttcagtcacagctgaaaacgcatcttcactcagcatatagcactggataccagtctcaagatctgaaggaatcttcgtttcatcctttacaaggatttctttcacaatgcccgggcttttcaacgcctcttcaacgaggtgttctccctctatcagaaatgtatttgtttttgttcgttctttttttgtgtgaagctttttccaatccttcactttttggttttttgccgattctatttgtttcactgtctatgtggcgctcctttttttaacatgatgttattatatcgcaagaacagcacataataaaccaggtgcagggttagaatatacgtattacattttagaaaaaggagcgttttacatggatcttaatttacgtcatgccgtcatctccaatgtcaccggcaataatcaggagcagcttgagcatacaatcgtagatgcgattcaaagcggtgaagaaaaaatgcttccagggctcggcgttttattcgaagtcatttggcagcacgcatccgaaagtgagaaaaacgaaatgctgaaaacgcttgaaggcggattaaaacccgccgaataagacatgaaaccgggtgacagcgcccggtttttttcttatataataaaaacatgatgagggggaacgccatgtttttacagccgttattagcgaaaaaaattattgctgaagtaaaaaaaatgtacgaacgtgaagtcattattgtaaacacggacggtcttattatggcaggcacaaacgatgaacgtgtcggacaatttcatgagggagcgcttatctgcgcaaaagaaagacgcagcgtgattattacaaaagaagatgaaacaagattaaaaggagtgaaagcaggcataaacctccctgtattttttgaccatgatgtgatcgccgtcttcgggctgacaggtgagcctgcagagattcagccattcggagaactgcttcgaaaaatgacagagctgttcattaaggaatcacggcatttagagcaatcccagtggcgtgagagaatgctggagtcctttatgatcgattggctgcaactaaaggagtggtctcccagttttcttgagaaagctcagcttcttggtgttaacctttcctcccggcgccaaatgattcttattcaggggtatgagtggtcacgtcatgatattgaacaaatggcacgcagctggaaatcctcgtaccctgcggatttgttcatcaggtggggaaatgaacggatcttgattaatcatgaagtgccgcagcatgaacaaagggatcggcttttacggaagatccttcacatttgttcgtttgccaataccgcaaacagccaatttgcagcagctggcgccggaagggctgtcgcaagctccagcctgacagattcatacgagcaagcggaaaaagcgctggctgtcagccttaagcgaaaaacgcccatatttgaagaggatctgaagcttgatatgtgtctgacggagatcagcccgggaacccgaaacgaatttccgcaaagagtattaggagaggcgctagagcatcaggaacttatgaatacgttacggactttctttcatcacgatttgtctttgaaacaaaccgcagaagatatgcatattcatatcaatacattgcgttatcgtctggctaaggctgaacagctgacgggtttacgttttgaccgtaccgaggacgtcgtcacgatgtacgtcgcactctattttttagatcaagatacaaaatagagagagtttcagtttcattttttgtatgtttctccatggaaggctttgctttttttcttttacaatagattgaaagcattttttgacagggggatgggtgaaatgatcaccaaggatgtaaaggaacagctgattcaggtctccggaccagaaaactttgatgactcgaatgccggccgtctcgtctattcatatgatgcgacgcctcagtatcagtctatgcctgatgccgtgattgctccgaggaatactgatgaagtatcacgcattttaacaatttgcagcgaacatcgagtgccgatcgttccaagaggatcagggacaaacctgtgcggcggcacgtgcccgactgaaggcggacttgtgcttctctttaagcacatgaaccagattcttgaaattgatgaagaaaatttaactgccacagttcagccgggcgtcattacgctggatatgatccgcgcggttgaaagcaaaggtttgttttatccgcctgacccgagttctatgaaaatatcaaccatgggcggaaacatcaatgaaaattccggcgggctccgcggattaaaatacggcgtcacccgcgactatgttattggactggaggttgtgctcgcaaatggtgacatcatccgcaccgggggaaaactcgcaaaggatgtggccggatacgatctcacacgtctttttgtcggctcagaaggaacactcggcattgtgaccgaagccatcgtcaaacttgttccaaagccggaaacaaagaagacgttgcttgctctttatgaaaacatcgatgccgctgctcaaacggtatcggacattattgccgcaaaaattatacccgccacgcttgaatttctcgaccagcctacacttttggtgattgaggattatgccaaaatcggacttccgacaagcgcaaaagcagttctgttaattgaacaagacgggccatttgaaactgttgaacgggatatggaaaagattgaggcgatctgcaaaaaaggcgacgccgtttccgttcagaccgcacaaacagaggaggaagcgtttgccctgactgaagcccggcgttctgcactttctgccctagcccgcctcaaaccgacgacgattttagaggatgcgaccgttcctcgctcagaaatcgccaatatggttaaagcgattaatgatattgctgctaaatatgatatttccatctgcacctttggtcatgcgggagacgggaaccttcacccgacatgcacgacagacataagaaataaggatgaaatggaacgtgtcgaacaggcttttgccgagatttttgagaaagcgattgaacttggcgggacgataaccggagagcacggagtcggggaaatgaaagcgccttacttggaaatgaagctgaaaaaagaaggcattgatgcgatgaaagcgttgaaagcggcatttgacccccggaacatattaaatcccggcaaaatgtttgcgaaagatgccagaaaacgtgtggtggcggaaagatgacaacagaaaaagaaatgaaacagatccaaaatgaatttaaagagcgtatggatgaaggagagttattaaattgtatgcgctgcggcttctgtcttccttcctgtccgacctatatcgaatcgggatttcaggaaacacactctccgcgtgggcgcatcgccttaatgaaagccgtagccgacggtatgattgaaccggatgaagatgtcgaacggtcgctgtcactttgcctcggctgccgcgcctgtgagcctgtatgcccgtctggcgtgaaatacgggcagctgcttgaggaagccagagatattatccaccaaaataaaaaacactctcttggtgaacgtgtcatgcgaaagacggcttttcacgagctgtttccgcatcaaaaccgcatgcgctcagctgtaagccttatcggtttgtatcagcgttcaggactgcaaaccgctgtgcgaaaatcaggcatgcttcggatcctgcctgagcatttgcggacgatggaagctgttcttcctgatgttccaaaaagcaaagacatgaaacatcggccgcgtttcctgccgtccattggccccatgaaaaaacgggtcgcctttttttcgggctgcttaatggatacgatgtttttaccgactaacaatgccacattgaagcttttacagctggcaggctgcgacattgtcatcccgcctgaacaggcttgctgcggggcgcttcatggacacagcggtgaaaaaaacacagggaaagagctcgcgaaacaaaatatcgctgctttcgaagcattagacgtggatgcagtcattacaaacgcaggaggatgcggagcctttctgaccgaatatgatcatttgctgaaggatgacccggaatggtcggagcgggccgccgcttttgttcaaaagctaaaggatttttcttccgttttggttgaacttgatttccatcaaatggacttagcgctcgagacgcctcaggtcgttacctaccaagattcatgccaccttagaaatgtaatgcatacgtcgcttgagccccgccagcttcttaaaagcatcaaaggggctgaattcaaagaaatggagaaagcagacagctgctgcgggtcagcgggaatttacaacatcgtcgaagctgaaatgtctatgagaatactggacagcaaaatggctgccgttaaagcaaccgaagcgattctcattgtaacagcaaatcccggctgcctgctgcagatgaagctcggcattgaacgcgaaggactaagcggtaaagtcagagccgttcacctggctgatttgctattggaagcagccgggcacaaaacatcatgagaaagcccaaaacagatattgttttgggcttttgtgcgttattccatcggactgcaaatttcgatataatgtccatccggatcagcgatataggcgaccgtctgcccccatggtttcactttcggctccccgataatcgatacgccttgttctctcatccttttgatgaccgcttctacattttcagtaacaaacccgatttcaaatgtgtttgaagcagatgtatccggaatgtccagcgccgtgatgtctctggcgctttcccgcgtattaagcgccaatatcgtagaccctgtttcaaattcgacatacgtgccgtgttcagcacgaatcggcagtcctaaaatatcccggtaaaaatgaatagcccgctggctgtccgatacgtatagaataagatatttcattgatagattcattgccaacccccctcagcatttttcaatagtccttctagcccggtatagatgcttccatccttaagctcggatctttccacatctgcgcccattttttcacagccgccacgataatgatgaagcctaacaccagcatgatgatagataatacgccattcaatacactatatcctgctgcttcaggattgagatacacattgcgcaccatccaatagcccgcataattgacagtgacatataaataggcaagcgggataaggcaagtcagaatgtaccggcgtttatcagcgattttcagcacgatcgtcgctccgataatcagccccactgaagccatcagctgattagaaacgccgaacagcgcccaaatggaaccgatatctcctgaatacagcaagtacccccacatcaaacaggcaagcgcgctggcaaatacagagcccggaatccagtctgttttcttcagcggtttatacacctccccgaagaaatcctggatcaaataacgggcaacgcgtgtgccggcgtcaatcgctgttaaaataaagaccgcttcaaacataatgacaaattggaaaaagtatgaggccaaatggctgaaaaacggcattccggtaaaaatataagtcatccccaccgcaagcgtgacggctccccctgttcttccttctaagtccaaaccgatttccccgctcaattcaggcaaatgtacgacattcatgccaagcgtacggaaaacctcaggcgtgctgttaatcgcaaagtaatcagcaggctgtaaagcggtcgctgcaatcagcgccatgatgccgacaagacactcaacaagcattgcgccaaacgcaaccggcttcatatcactccatttattcagcattttcggtgtcgttcctgagccgacaaaggcatggaacccagagatcgccccgcaggcgatggttattgagatgaacggccagacaggtcctgccagcaccggcccgccgccttttacgaattctgtaaacgcaggaaacggaatagacggattgacgacaaacacaccaacaatcaaagcgataaaaacaccgattttcataaagctgcttaaataatcacgcggtgcaagaagcagccaaacgggaagcgcagccgcaaaaaacgcataaacaggaagcgcgattgcaagcgttttcgtatctagcgttaaaaagtcaccgagcgcggtagtctgtacccatggaccaataaagactcctgccattaaaaagagaaagccgaccgttgaagcgagctttaaatttcccgttttcttataaaataagcccacacccatcgcaatcggaatcgtaatccctaccgcaaatgttccccatggattacgttcaagcgcatgcaagacaaccatcgacaggcccgccattgtgatcgtgatgataaacagcatggacagtcctgtacaaaatcctgcaacagggccaagctcatccttcgccacttccgacagcgattttccgtttttgcgcatcgatgcaaacaacaccacaatatcatggacggctcccccaattaccgccccgattaacagccacaataatcccggcaaatagccaaactgcgccgccagaattggtccgaccagcggcccggccgctgcgatcgcggcaaagtggtggccgaacgaaacccatttatttgtaggcacatagtctttcccatcctcaagcgcatgagcaggtgttggcttgtcatcattcactttgagaaccttcaccatcataaatgttccgtataaacgataggcaatagccaaaatacacattgatgctatcacaattgtaaccgcattcattttctcccatcccctttgctgtttttcataaatatatcacaatttcatggtgaaaagcggtcattttttcctatacaaaaagccggcttgaacgggccggctcgtggcagttgaaagacaagccggagatttctctccggctttgctattcttatgactgttttttcaggcggatcacattccaggaaagcggcgtgaaatgagcagttaagccgttttcgctgacagacgatgatccgttggaatgcggaacgacattttttctgttatgctggtttgtcgctttgatatcctgatgctcaagtacgatgtgctctgcgatttggtaagattcaaagcctctgagcgaaatctccgtctccatctgatcctcagccttgtttaccgcaaaaatagtgagggtttcttcctcttcagagtacacaacagcagcatcaacatatggcacatcagtgaaatcagaacaatcgtacttaggagaagaaataagcggtttcagtgactcgccccttccgtaaacagaagcatgcatgtatggatagaaaatcggctgtctccatgcttctccgcctttttccgtcatgatcggcgcgatgacattgacaagctgtgcaagacacgcaattttcacacggtctgcgtgctgcagcatcgtaatgagcagagagccgactaataaggcatcttcaaaattgtaaatatcctctaaaatcggacgcgcagtgatccacggctcgacttttttatcagcctcatttgagtggtaccatacgttccattcatccagagagagattgatagttttcttgctgcgtgtttttgcttttacatagtcacaggtcgcagcgactgatttgataaaatgatccaaatccatggaacgggccaagtagtttggcagattgttatcccggtttccgtagtaggtgtgaagagagatatagtcgacatgctcatacgtatgctccagcaccttcgcttcccaatcgataaaggtcggcatgccgctgtttgagctgccgcaggcaacgagttcaattgatggatcaacccatttcatgacctttgccgtctctgcggctagccgtccgtattcatcagctgttttgtggccgatctgccacggtccatccatttcgtttcctaagcaccatgttttaatgccgtacggctgttcatagccatgcgatcttcttaaatcactccagtaagagcctttcgggtggttgcagtattcaacgagattacgggcggcatctatgcctcttgtgccgaggttgacggccatattgacctcagtgttcacctttttggcccaagataaaaattcatttgttcccacttcattggtttctgtcgtttgccatgccaagtcaagccttctcgggcggttttcgactggtccgacaccgtcctcccagttgtatccggataaaaagtttccgcccggatagcggatgatgggaacctgtaattctttgatcagcgactgaacatcttttctaaacccatcttcatccgcttcagggtgatcaggctcgtatatgccttcatataccgcacgacccatatgttcgataaacgagccataaatccgtttatctacttcaccgattttatattctttgtctacaatcattcgcgcttttttcatcacacgtttcctccttcattaacctttgactccccctaccgtcaggccggagataaagtacttttggaaaaacaagaaaatgataatcaccggcaaaatcgcaaatactgagccggatataagcatgtcgtaattatttccataagggctcagcaagctggacagccctattggaagcgtaaacatttctttcgaccgaagcacaatcagcggccacaagaagttgttccagctgtttaaggactgaaggataatcatcgcaccgaaagccggtttcatcagcggtgccataatcctgaaaaagatgccgaattccgtacagccgtccatccttgcagagtccagcagatctcttggaaggccaagagcatattgcctaaaaaagaaaacggcaacaggtgaaacgataaacggcaatatgacacctgtatatgaatcgatcaagtgcagtccgacggtaagcttaaacagaggaagcatcatcacttccagcggaaccatcatgataatcagcacaagaacaaagatgatatttctgcccttaaaatcataaaccgcaagcccgtacccgatcatcgaagaaaaaaacagggtgagcacggttgtgaaaagcccaagtacaagactgttaaaaaaccatttgaaataaatgcttccgccgttaaacagaaatgtataattatcaagactcattactttaggatcaatgtcgagattgagccccacacgcaaaagctcagatgacggctttaatgatcctaaaagcaaacagaaaatcggaaaaagatacaataggctcagcatcataaaaaacagggttagtgcgattctgtaaacgctgaactgaggactgtgccgcaacatttatccctcccccttaaacgagcctgacagctttaatgaaatcaggctgacaacaaggatcacaatcaaaagcacgatgccgatggctgctccgtaccccatttcgttgtaggcaagcccctgctgatacaaatatccgacaagcgtcagaccaatattacccggggaattattctgccaaaggacgtagctttcctcaaacatcctgaagccgccgatgatgctgatggtcagcacatatacggttacaggcttgagaaacggcagcgtgatgtgcagaaattttttcattgtattcgcgccgtctatatcagcggcttcgtacagctctttcggcacattttgcaaaccggctaaaaagtaaaggatgttgattcccatccatctccatgaagcaagcagcaccatcaaaaacatgccggtatgttcattgttcatccagttctgaggtgaaaagccgagtttgagtaggatggaattggccagagacgtttccatttctccgaagatcagccgaaaaatgatccccgcgacaatggttgaggtcaatgccgggataaataatgctgatttaaatatatttctaaatttgaccagctttgaattcaggaatatggccagaagcaatggaacaggaatcagcacgatcagcgtccaaaaggtgtattccagcgtattccaaagggcggtatagaacgtcgggttgtttagcgctgtataattagacaatccgacaaaggacacctctcccggcaaaattctttggaagctcatgatgaagacactaatgatggggtatagaaaaaatacgagaaaggataaaacgaatggcgctgtaaacagatagggcgccgctttttttgaataaaacagatctcgccagcctgattgtttcgcagctgaaggaacgggatgaaccgttcctgttttcacaggtttcatgagaacctccccgctttcactttttgaatgggattctatttctgtttcagttcacctgccgctctgtccaaggcttgtttaggcgttttttgctgagatttaagtgcgtcgaacaacacgcttctgttgacaaggtctgaagccttggcaaaatcctcatgtaaataaatcggattgatttcatccttgatatcgagcagcacagaaaaaatgcctgttccgttttggaagtaatccgtgtatttgtttttctctttcaattccttggagctccaaacatcccagcgaagcgggtcaaagccgagtacgctccagagttttttatttccttcttcagagcccttcgcaaaggccaaaaactcttttgctaactcaacatgcttggattgcttcggcacaacggttgccgtaccgcccaagcctgccgagcggtcgcccccctctttccatgccgggagcggcctgatggcaatcttccctttcagatcaggcatataatcgataaatcttcccatataccaaatcggcatgaggactgaagcagctcctccttggttcataaagccgtagtattcttcactgtgatgcccgccgcccggcgcaggaatcatcgttttatcattgatcatgtcttttaaatattgaagtgtttttacgttggtgtcattattgaggatcagcttgccgtttttatcaaaatagcctgagttttgctgtgaaatcatagataagaacgttgcggaatcatttgtttccaccgttcccatcggcttcccggtcactttgcgcactttctgtccggctttatggtaatcatcccatgttttaatatcgtcaggattgacgccggcttttttcatcacatccatgttataaaacatgaccgttgttcctacatgcgtatcgagtccgtaaagcttgccgtttttgctgtacagggtcagccgcgcctcaacgaatttatcgcggtccttttcaatcagcggagtcaagtcggcaagcggtatgtcagagcccttcaaaaagtttgaaaaacgggccaattcgacatcggcaatatcagggacgccttctcctgcaattaaggagatagacaagttatcgtgcatttgtccatacggataaacgaccgtattcagcttaattttgcggtcaggatatttttcattccattccttcaccatttctacatagaactgctcatgaagtccgttaaatgtccaaaaggtcagctcggtttcacccgacttcccggatgatctttctgctgaacacccagcaatgactaatgtcaatgtcagcaacatcatgagcacaagaaaacagacagtcatttttttcatctgcgttaccccttccattcgaggtgcgggctattcatatagaccatggttgatcagcgttttgttttcattgatgattcttaatccggtgcagcggtctcttaaggtgtgcgcgtgtctgaaggcattcttgacggaatcctgcccgacaccgatttcgtcaaaatacgcagggcctccggctgatctcagccaatcagccagcacttctccttccgggagagtttgataagccgattggatggcttgccgccggctcggtgaaaattcgttcagcccgtcatccttagcgagctttctgtatgtgtcagttaataaaacagctgcacagcccacctttgccccatgaagaatctgtggccgttttttctccattaattccatctcaatccaatgtgaaatatgatgctcgccgcctgatgccggtcgggaatgatctaatgccagcatgacaagccccgatacaagtaaagactccatcaaaacccgtatgccagtttccgttttcatcgcaatgtcttctgtgtgttcaatgcaggcagcaagcgcctcctgaacaatcttagctcctgctggcgaataaggctcgccggcaagatgccgggatatttcccaatctgctaaagacgttattttaccgagcatgtcaccaaagccagctgccaccattgactgcggtgccgcttttaatagatccagatcagcgaacagtgcagatggggccttcgtttgaatggttgttttcgtgccatataaaataatcggcgcaccggctgatgtaaaaccgtctacagatggagcagtcggataagaaataaacggcaaatctctttgaaacgccgcaaagcggacgatatcatgaatcgtgcccgaaccgactgcgatcatgacatccgttggttgtttcgtatggatcagcacatgaatgagcgatcgttcatcagctgtcacatctccggcttcattttctggaatgatcaggcactcggcctgaaatccttcttgattcagctgattttccagatcaattcctgcaatgcggtgtgtattcgcatcgcagacaaggacaatatgtttattgtttttttgttttacgtaattcaaaagcgaatcagctgcttgtttaccgagaacaatttcttcaacttttataggcaacgtcttttctccggcgtgttcaaaagcacgctgaacgtcagctgcgatacgattcatatcagaatcccctcctcagccaatttggttacatccttaatagaatccagcacataatccggcgtgtacaaacgctgttcgccctgtttcgcagaaccagttagcactaaggcgcttttcatgccataaagcttccccatcgcaatgtcagattcaatgctgtctcctataatcatgcattcatgtgcggacagccccattgctgtacaggcagcctccgccatcagccatgacggttttccgacaacaagttcagtcttcgcttgtgcggaagcctctatcgccccaatcattccagccacatcaatggcatttccgtcttcgttcggaaaagagcggtctttgtttgtagcgataatacgagcgccgccggcagccgcttgaaaggcttgatttaaatcgtcgtacgtgagcgtttcatgaagggagatcacgagccaatccgcttccttcggttcgttcgcgttctgcacaccggccagcctcagctcgtcaaccaagccttgttccccaagcacccatacctttgaaaaacgataatgttttttcagaaaagccgctgtcacgcttgatgacagaacaatgtcgtttacgtccgtttcaatccccgcgccaagaagtttttttctgcacatggcacgggagatattcccccggttgcttaaaaagacgattttctttcccattctcctaagcgttttgatcgcttctcttgctccttcgatcaactcatttcctctgaatacagtaccgtccaagtcaatcagaatgccagccggtgacacaggcgtatcatgactggccataatacgcatttgctccgtgttttcgataaaaatgcttttcatgcaggactgtattgattggggttacatccttgttcagcataatggagtgataggccatttcggcaaccgtttctaatacaactgcgttatgaatggcatttaaggcgtcagtgccccagcagaacggtccgtgattattcacgagcacacccggcacctgttcgtagttatgatgctgaaaggtttccgctatgacttttcctgtattcagttcgtagtcatgaatgatttcttcatcgtacatttcacgagtacatggaatcgcactgtcaaaataatcagcatgggtcgtgcctaacggagggatgtctctgcccgattgtgcccagcttgtcgcccattgagaatgggtatggacaattcccccgatattcggaaaggctttatataaataaacatgggtaggtgtatctgaagaaggcttaagcgagccttcgacgacctctccatcaaggttcaaaacaaccaagtcatcggctgtcaggtcgctgtattcgactccgctaggtttgatgacaattctttctttttcacggtcaatgccgctgacatttccccacgtaaaggttaccagctgatgctcttgaagcttcaggttggcagccagcacttctttttttaatgtttcaagcatgctccatcaccctttatcaattctttttggcggcagatgaaaattgaagatttttgatcgttttcagacgtttcatgacatggttttcttttccgaaataatgaaccagctctttatattcagcgtacaatttttcataaaccgcggcgttttcggcatttggcgtataagttatatctttcagttttcccatgttcgccgctgcctctttgatgtcatcgtagccgcctttttctttgcctgctgcaagcgcgccgaaaatggcagatcctaaggctggtgcttgcggtgaaccagagattttaatgtccatgtttgtcacatccgcataaatctgcatgacaaacgggtttttctcagctattccgccggctgcgtatagttcctcaatcggaacaccgctttctttgaatgtttcgataatcattcgggttccgtaagctgtcgcttcaactaacgctctataaatctcttcaggcttcgtcagcagtgtcatgccaagcagcatccctgttaaatctgcatcaacaagagttgaacggtttccattccaccaatctaaagcaagcaagccgctttcaccaggcgcttgatggtttgctttctcactcagcagctcatgaacgccaatgtttttttcctttgcttcctcttgataagctggcgggacacatgttttcacaaaccagtcaaaatgatcgccgacacaggactgcccggcttcatatcccgcatagcccgggagaattccgttgtccacaacgccgcacattcctggaacgatatgcacctcttcaccaagtagaacatggcacgtcgaggttcccataatcatcagcattttccctggctctgtaatgccgaccgccggtacggaaacatgagcgtccacattggcaaccgcaacagccgttcccgggagaagtccggtcagctttgccattttttcagtcagactgccggctttttctcctactgaatgaatagaacctgacaatttgtcttttgtaatcgttttcattgaaggatttaatttctcaaagaaatcatctgacggataccccgctttttcactccacatcgctttataccctgcggtacaattgcttcgcttgagcgagccgcacagctggtacacgatccagtccgcagcctcgatgatccggtcagccgcttcataaatgtgaggcgcttcctcggcaatttgcatgacctttggaatcatccattctgatgaaatttttcctccgtaccgctgtaaaaaagcctctccttcttcttccgcgatttgattgagccgatcagcatgtttttgggccgcatgatgcttccagagcttcacatagctgtgcggctcctcttcatattcaggcagcatgcataacggctgcccgctgctgtcaataggaaggatcgtacatgccgtgaaatcaattccaatcccgataatgtctttcggttcaacgcccgtctgttcgagtaaagacggaatggttgtttccaagacttcgaggtaatcagcagggtgctgcagcgcccagtcgcgcggcagcttttgacccgtttttggaaggacggtatcaatgacagcatgcctgtattcttttacagcagccgcaagttcctcccctgtttggacatgaacgagcaccgctcttcctgataaagttccaaaatcaacccctattgtgtaagccatgtgacatccccctctacttttgaagccggtaaagcgcctcgttccattttaactcgtgtttcagtttatgaattgtcgtatcacgggaaatgagaacactttcgatccccgccatttccgcccaatcaagcatttgctccgctgtcagttcataagacaggcaggtatgatgtgcaccgccggctaaaatccatgcctccgctgctgttttcaatgacggctccggcttccagagaacacgggcaaccggtaaattcggcatgtctttttcaatttcctggccggtgacttcattcagcacaaggcggaaacgcccgccaatatcaacaatgctagcttgaatggcagaacccctgatgccgttaaatacaaaacgcgcagggtcctctttgccgccaatcgaaagcggatgaacctcgattttcggctgatccaaagcgacagtcggacacacttcaagcatgtgagagcccagaatcatttcatttcccggttcaaaatggtacgtgtaatcttccatgaaggaagttctttttcctttagccatgattttcatcatccgtacaagggccgctgtcttccaatctccttcaccggcaaacccatagcctttctccatcaggcgctgaacggcaagtcccggcagctgtttcattccgtgcagcacttcaaacgatgtcgtaaacgctgtgtatccgccttgctcaagaaaagcggttaagccaagttcaattttcgcctgttctttaatggacgctacctttgcttcgtcacgttttgtttcctcactgatcacatatagtctgtcatactcggcataaagcgtgtcaacctcgtcgtccgtaatgcggtccatcacttcaacgagatccccgatgccatatccgtcaacctgccagccaaattgaatatgcgctcccaccttgtctccgtccgttaccgcgacatgacgcatgttatctccaaatctggcaaccttaatatgtctgctttcatttaatgcagccgccgtatccatccactgggacatttcttttttcacttcttcatcatcccaatagccggcaatgacttttcggctaagccccattctcgagttgatgtaaccgtactctcgatcgccatgcgcggattggttgctgttcataaaatccatgtcaatcgtaccccacgggatatcgcgattatattgggtatgcaaatgcataagcggtttttgataagaggaaaggccttctatccacatttttgcaggggaaaatgtgtgcatccatgtaatgatgccagcacatgtctcactgtactccgcttctcttaacagccctctaatggtttccggtgaagtgacgacgggcttatgagtgattttatatctggaagaaatcccgctgagcccctcacaaatgcttttagcatgctgatctacgagttccagcgtctcttccccgtataggtgctggcttcctgtcacaaaccagaattcataatcctttgtctgaagcatgtaaactgcccctttctcataaaataaaacgctttcaaatacaaaagatacgtactaatgatagaaaataaacctataaataaatatttgtacgaacaattttattatagtaattgactattatactgtcaatcttttctttttaaaaaagccgggggcagagcccggctttttgattcaataggacggccagcccgagctccaattcaaatcattgatgagaagctttggaatgccgttgtcattggcatcataggcatggcgaacaagaatgtttccgttcacaatatcctggcctccaggtcctttccattggtcattgcccgaatccaaaatggtgcctccgccttcaagcatgctttttccgcttttatcaagataagggcctgtaatgtttttggatcttccgtaagcaattttgtacgtactgtttaccccgtcacagcatttatcaaatgaaaccattaaatagtaatagccattttgatacgtaagagtaggagcttctaaggcacccccattattcggtctagctgcaatcgaatagagcgagcctgtaggcttcatcgtactcttatcgagcttagtcagcttaatgccgctccaaaacgagccgaatgcaagccacggattgccatccttgtcgaatgtcagctccgggtcaatggcgttataattatttgagcttgtcgaacgaatcaccaagccctcgtccttccagctccccgaactgatgcttgttgaagatgccaggccaatggcagatgtattgcttccaaaagaagaaacggaataatatagccagtacttgccgttatagtattggatgtccggcgcccactggttttgaccataattcggcacataattggaccaccacgatagcggtgtagtgaaaatggatttttgtacggtccaatttttagcgtctgaagacttcaaaacccgcagtccccgttcttcagtaagccctgttccaagcgcataccatgagctcccctctttaatcatagtcgggtcatgaagcagctcattggatgcaccccaaaacgctgcctctgcgggagcagcagaagtgaatatcaaacctgcagccagagctgcactcgaaaagtgtaagaagcgtttccatgtttttttctttttcaattttgtttaacctcctttatattagaaagcgcttacaaattagattgtttatcctcccttcctgtcaaatcgagctgcgtatcgtatatcgtcatgttcaggaaattttcggtatcccctttattgtagtcactatgctgtaatttgtacagacaaaaaaatagaatccgcctaaataggcggattcttccgtatctttattggtacgtaatttcgtcaaccgtttttcggtctaacttcttaatgacttccgtaattaactttaccgcgttttcataatcatcacgatgcagcatggccgcgtgcgtatgaatgtagcgggttgcaatggtaatggacagcgcaggaacgccattcgccgtcaaatggatggcaccagaatcagttccgccgccggcaatggcatcaaattggtacggaatgccggcttcctccgcagtggctacaactgcatcgcgcaaacctttgtgagagaccatggatgcatcgtaaacgataatctgcgggcctttgcccattttgctctgcgcttctttctcggaaatgccaggcgtgtctcctgctatccctacatcaacaccaaacgcaatatcaggctgaatggtgtgtgcagccgttttcgctcccctcaggccgacttcctcctgcacggttccgacgccatacactatatttggatgatctgtgttttgtaagtttcttaacacatcaattgcaatcgcacagccaatgcggttgtcccacgcctttgcgagtaggaatttttcattgttcatgaccgtaaattcaaaatgcggaacgatcatatctcccgggagtacaccccactccaaggcttcttcccggcttgaagctccaatatcaataaacatgtcttttatttccactgatttttttcttgcttcaggagataaaatatgcggcggcttagagccgataaccccagtgatttctcctttaattgtgacaacggtgacgcgctgggcaagcataacctgagcccaccagccgccaacggtttgaaaacggataaagcctttatctgtgatttgtgtcaccataaagccgacttcatccaaatgtccggcgatcataattttcgggccgttttctgcaccagtttttttggcaattaaactgcccaggcgatctgttgtcacctcatcagcaaatggttctatgtatgatttcatcacttgccttacttctctttcattgcccggtatgccttttgcatctgttaaatctttcagcatggtcaatgtttcatctaattttgccatgttccaaaccctccttcatcagtcctgcattcttattatacaaaacatggcgctaaccatacgactatttcacttgaaaatcgggtatatgtttttacagctttcttttagaaaaagtgaaacctttttctatgcttttcgtattacatcagatcatcaccataagggaggtgccttcacacaatgtttgtcatggttctaaggattattttgcttgcactttttgcttattgtatttatgccgtggtcaaatatgtcgcgaatcctaagagaaggcttaagctggcccaatcaaaagaacatttttatattattgatgaacaaaacaatacccggaagaattttcagctgacgtataaaggcgtgctttttgagggagaaaagcatattccttccaaggaccatccgctgtttattcacacgatctttgtctggacagaatctcctgagaagctgaaacatttctctgcaaaagattttgagaacattgaagaaaaagtgctggaacgatatccaaattgtaagattgactgggaccagcccattaaactcgcaaaaaaagcagaagagcgttaaacgcttttctgctttttataaatcaaacgggctgtagtaaatagcgatgagaatcgcttcaattaccagaagaagcggtactccatacttaaaagaagcgtgtttcgttttatgtctgaaggtttgcatgccaagccagacaccgagcgctccaaatacgatggctatcagccacagccggtcttcagaaattctccacttgtgctgttgcgctttgcgtttgtcaatgcccatcacccaaaaaccgcacagattaatcaacaccaaataagctgcaataatcatgttgcctcatcctttatatagaaaaagccgctctgctggagagcggctctatatgattacttgtttaattgagctttagcagcatcagcaagctgattgaatgcagtaagatcgtttacagcaagatcagcaagcattttacggtttacttcgataccagaaagcttaagaccgtgcattaaacggctgtaagaaaggccgttcatgcgagcagctgcgttgatacgagtgatccaaagtttacggaaatcacgttttttctgacgacggtcacggaaagcatagtttccagatttcatgacctgctggttagctactttgtataatgtatgttttgaaccgaaataaccttttgctaatttaagaacctttttacgacgcttacgtgtaacagttccgccttttactcttggcattgaatttccctcctaattgttccttatccgattacttgatgttagcaagcatttgtttgatacgtttgaagtctcctgcgcttacaacagcactcttgcgaagcttacgcttttgcttttgagatttgttggcgaataagtgacttgtgtacgcgtgagaacgttttaacttcccagaacctgtctttttaaaacgtttagcagatccgcggtgagttttcatttttggcatgggatttcctccttattgcttttcgtttttcggtgcgagcattaagaacatgctgcggccgtccatttttggttttgtttcgactgtcgcaacctcagcacatgcttcggagaaacggtctaatacacgctgaccgatttctttatgagtgattgcgcgtcctttaaagcggatagaagctttcactttatcgcctttttcaaggaatttaatcgcattgcgcaatttcgtgttaaagtcatgctcatcgattgtcggacttaaccgaacttcttttaagttaatgattttttgattcttgcgtgcttctttttcctttttctgctgctcaaatcggaacttaccgtagtccatgattcggcagacaggcggttttgcattcgctgcaactaacacaaggtcaagatttgcgcggccggcgatttcaagtgcttcctgacgggacttgattccaagctggtcgccattttgtccgattaaacggacctcacgtgcacggataccctcattaaccaattgatctttgctaataatgagccacctccatagtttcttcgaattgattcacaactcattttgtatgcattttgcaggcaaacaaaaagtgtgggcattataaaacacccacactacgaacatctgtatcaataaaaatgtacggtcaacctgccaactacatgcatgtgtcaatcaggtgagaagcgggtgcttctgcttgtgatttatattcaattcaataactattctacacaataccggatctttagtcaaggacgacttatccggaacaacttttacattgtaacatgggttttctatgagcgcaagagagaaaaagaaaatctttcatcccccccagaatgcaaagaaccaacaattccccccttatttcgcaatttacaacaaaaccaccgacaggaagaaatgtaaaacaaagttaatctctgaccgatataagaagcagaagggagcctgacacatgaacaaactgatacagcttgctttatttttcacattgatattaaccggatgctcaaatagcagcacatcttccgaatcaaaagtcgaaactgttaagacaactgcagcatttcctcaaaaggggctggagaaagagctaaaaaaactaaaacccgtttcattggacatgaagttcgagagtccacttgctactgagttaggaaagcggaaggcaaaagaagaagctgaaaagcaaagacaaatcgccgccgagaaaaagcttgaaaaagagcgggaggcgaaacgaaagaaacagcacgaggaaaaagcggagagacagcgattagcagagcagcaggcggcagagaatcagcgattagcggaagcaaaaagacaagctgaacttgaaagacagcggcaggcagcaatccaaaaagagcagaaagcgaacgctgagaaaaagcggcaatcgcaggcacaacggcagcagactgaggcacccccatctaatagtcaagatccaccatcttcctcgagtcagacagataaaaccattcaacagccagcttcagagcttcctgatgacgatggttatggttatgaagaacgaaaaaagtggcatgacgatcaagtagaatggggcattaaacaagggtatatcgatcccgaagacgcaccataaaataaaaaaagccaaggcattcagccttggcttatccaccgatcagctgcacgaacacagggatgaccagaaccgttaccactcctactacgacaacagcaatacttgccatcgcagcttcaacttctcccatctcaatcccgaccgctacaccaagtgcatgtccggatgttccaagagccaatcctttagaaatcggatttttcactttaaacaccttcaagaacaatgctccgagcgcatatacgatgacagcgttaaagatgaccgcaaaggctgtgatgtcgctgatgcccccgatgccttttgataaaggaagcgcaattgccgttgtagccgcctgcggaagcatgcttttcattacggccgaatcgagatgaatgcctttagcgagcaaataaacaatcgtgacagagcagatagagccggcaataatggaggccatgatttgccaccagtactttttaagcttatctctttgtttgtacaaaggaattgcaaatgcgatcgttgccggttcaaggaaaaacttaatgatctctcccccgttattataatccgcgtaggaaaaaccgccgatttttaaaaatgcgatccccagcaccatggcaacaaacaaaggagtgaaaaggaagaagcctttcgttttcttaaataaaaaggtgccgatgccgaatgcagcaagtgatacgacaatcccaaaataaggactcattgtgctttccatgtgaagaacctcctgtttcccttaatggtgaacgagttcgttattgttctgcgggctttgcactgtttttgttttcatgtccgctgcggttttgcgttttccgctcagcgacagaatcagctgagaaaacaatcccgtagcccccagcaaaataatcgttgcgagcagaatgacaagaacaatttgcaggccgtattgctgcatcacaccgagcgaattcataacagatatacctgacggaacaaataaaaatccgatcagagaggtcaaagacgttccgagcgtctccacttgttccagtttaatgactttcaaacataataggagaaataataagaccaaccctacaaccgatgccgggataggtattgggacaatagcggcaatcatatttgaaaccagcataatgacggcaaaaataaatgcttgtgttaaaaacccgtacacttttttagcactcattttcttcacctctttctctttggtacccccattataaataagaattccctgttataaagcgcttacaagataacatgccgaatagcgggtctgagttgcagaatcaaatggctgaaatgcaaaaagccgcccatcaaatatggagcagctttttcaattccttcgcatatgtccggctgaccggtattttcgatccgtctttcatgatcaaattatacgttgaattaaaccatggctgaatttctttaatatattcggtattcacgacaaagctccgatggacgcggataaaatcagaatccggcagctttttctcaatcacaacgagtgtatcgctgaccgtataagaatgatcgaaggtttttacattgacatgaccatcttctgttccggcatagataatgtccttcgtatccacaatcacaatcgattcccccacagatagcgcgagcttgtgctggccggcatggctgttttgctctgtttctacaatatcccgattgacttttttatattttttcagcgtttgctgaattctttcttcatcgaatggcttggttaaataatcaagagcatccacctcaaacgctttgagtgcatactggtcatacgctgtcgcaaacacaacagcaggaggatgcttcattttcttcaatcgctttgcgatatcaaaaccgttttctccagataaatcaacgtctaaaaacagcaaatcaggtttttgatccatcatttggtcaaaagcggattcgatattttccgcttcattgatttccatttcctcattggtccgcttaagcaagtaagccagttcatctcttgccagcatctcatcatcaactattaacaccctgagcatgttcttctccctctttcatctgttgcattggcacttgaaaggaaacctctgtccctttatgaacctcactgctgatatgcagtgcagcctgctgtccgaataaaccgatcagccgctgatttaggttataaagcgctgtaccggttccctccttagacggaaacggtttctttcccagttccggcaagacgtccggcggaattccgcgtccgttatccgccaccttcatatagacggatgcattatcagataagacacagactgtaaccttgcatatgtcttgttttttcggaaacgcgtgccgaagcgcgttctcgacaagcacctgcaaaacaaacggagggatttcaatctgctccagtctgctgtcgatattaagctcaattttatatttcccgggaaaacgcgcctgttctaatgacaaataggcgttaagatggtttagctcctttgagagcggaatcagcagctgtctcgctccttgaaggtttgaacgaaaataaacactgagctgcaataggagcttacgggttttttcaacatctgtacggcatagcgcagaaatcgtgttgatcgcattaaataaaaaatgcggattcacctgtgcttgaagcgctttaatttcagcatccttgagaagtttgctttgcagctctgcttccccaagctcaagctgtgtcgaaaacagcatggccagcccctcggcaagttcctcctctacctgactcaggcctgccgggcttttaaagtacatttttaaggtgccgattgtattgccgttcgatgtcagcggcagaacaattgcagcgtgcaaagggcattcagcatgcgtgcattcaatctcttcctgcgaaatcgccttcataatatgccctgttttaatcacctttttggacagcccggtgatcaaacttttcgatgggatgtggtgatccattcccgcaccgacatgcgcaaggatcttttctttgtcagtgagagacaccgcatctgttcctgtcagcttatggataatagccgctacacttttacaggagttctcatttaatccttggcgaaaaaatggaagtgtctgatcagcaatcgtcagcactcgatgcgtttcgagagcccttgcctgttcttccttgcgaatgatcgcttgaataatagacagaaaaataaaactgcctgttccattgatgagtatcatcggaattccgatcatgctgacaagctcccaagcgtcactgaacggctttgccatcagcaaaataatgatcatttgcagtgactccatgccgattcccacaagagcggcgatgcgcggtgtcggcattcgatatcgcttcgtaaaatacctgccgatcaagcctgcaagaacacccgctaaaatagatgagacggcacagcttaaggccgtgctgccaccgagtgaaaaacgatgcaggcccgcaagtatgccgatcccagcccctacaaaaggacctccgagaaggcccccgatttccacgcccaaaatacgggtattcgcgatagagcccgatggatctatcgtaaacacccagtcattgtttacaatcatatttctttgaatttcgatgcctgtataattgctgatgatgctgaaaagagaaaaaatagaaattaaaatcgcttttcctttatagccgtcctgattctgaagagcttgtctgaaaagtttcgtatgggcgagaatgaaccctaatataacaataatccccactctctccagcatcataatcattaaatgaatcattcatgtcacctgttctttccgttttcattctagcatgttttcgttttacggctgactgtttttttaaaatcgtctgaaaacatatttcacaaggcttttatctattgtaaaataaaacatgagccttttggcagaaagatttgaatctgaagcagaggagaagatcatgaaagccgtattttttgatttagatgatacactactttgggacgaaaaaagcgtcagaacaacatttgcagaaacttgcttacaggcggagaaaaaatatggccttgcccctgaggaattcgaagcagctgttcgcgaagcggcgagagaattgtacatgtcatatgagacgtatccatatacagtgatgatcggcattaacccgtttgaaggactgtggtccaatttctcagagccaatcagtgaaggctttcaaaagctgaacaagattgtgccggagtacagaagaaatgcatggacaaacggactgaaagcgcttgggatcgatgatcctgcatatggcgaatacttgggagagttttttgcggcagagcgcagaaagcgcccgtttgtatatgatgaaacttttgctgtactcgatcaattaaaaggcaagtatgaattattgcttttgacaaatggcgatccgagtctgcaaaaggagaagcttgccggcgtacctgagctcgctccttacttcaatgaaatcgtcatctcgggcgcattcggcaagggcaagccggatgtttcaatttttgaacactgccttaagctgatgaatattgaaaaagacgatgccatcatggtcggcgataatttgaatactgatattttaggcgcttcaagagccggaatcaaaaccgtttggatcaaccggacggataagaaaaacgaaactgacgtaacgcctgattacatcatcagcagccttcatgatttgtttcctatattagagaaataaaaaagcatgatctcttcaacgagatcatgctttttattttattttttcgcttcagctactgcctttttcacaaactcatcaagtgaaatggtttcagagttctgctctccatacttacggacgtttaccgctccgttttctgcttcttggtcaccgaccaccagcatgtacgggattttttgcatttgcgcttcacggattttgtagccgattttttcatcgcggctgtcgacttcaacacgcaggccttcacgctgcaggcgttcctgcacttttttcgcgtagtctaaatgcacagccggagaaaccgggatgacttggaactgaaccggtgcaagccatgtcggcagcgcgcctttgtgttcttcgattaagaaggcaacaaagcgttccattgttgaaacgacacctctgtgaatgacaaccggacggtgctgcttgccgtcctcaccgatgtatgtcaggtcgaaacgttccggcaataagaaatcaagctgtaccgtagacagtgtttcttcttttccgatcgcagttttcacctgaacatcaagtttagggccgtagaatgccgcttcaccttctgcttcgtaatagtcgtggccgatttcgtccattgcctctttcagcatggattgcgctttgttccacatttcatcgtcatcaaaatatttctctgtatcttccggatcgcggtaagacagacggaatgtgtaatcacttaaaccgaagtcttcatatacatcctggattaaacggactgtacggataaactcatccttaatttgatccgggcgcacaaagatgtgtgcatcatttaacgtcatcccgcgtacgcgttgaagccctgacagcgcacctgacatttcatagcgatgcatcgttccaagctccgcaatacgaatcggaagctcgcggtaactgtgaatgtcttgtttgtaaatcatcatatggtgtggacagttcatcggacgcaatacaagtgtttcattgtccatttccatcggagggaacatgccttcctgataatggtcccaatgccctgatgtttcatacagctctttgctgccaagcacaggtgtgtatacgtgctcatagccgaggctgatttctttatcgacaatgtaacgctcgatgacgcggcggattgtcgcgccttttggcagccaaagcggcaggccttgtccgactttttgagagttcgcgaacagctttaattctttgccgagctttctgtggtcgcgttctttcgcttcttctagcatacgaagatgctcttcaagatcagcttttttgaagaaagctgtaccatatacgcgctgaagcatttggtttttgctgtcgccgcgccagtatgcgcctgcaaggcttaacagcttaaattctttgatttttccggttgaaggaacgtggacgccgcggcacaggtcaaagaattcgccttgctcatagatcgaaacggtttctccttcaggaatcgcatccaatagttcaagcttcaggtcgtcgccgatttccgcaaaacgggctttcgcttcttcacggctgacttcttttcgaacgatcggaaggttcgcattaacgatttttttcatttctttctcgattttcggcagatcctccggtgtaatcgcttcgtccatttctacatcgtagtaaaacccgttttcgataaccggaccgacgccgaatttaacatccttgtagatgcgtttaatcgcttgagccagcaagtgagccgtactgtggcgcataatttgaagaccttcttctgagccttctgtaatgatttccactgtaccgtcttcattgatcggcgttctcaaatcgatttcttttccgttcagttttccggctaatgattttttctttaatcccggactgatggatgccgcgatatcttctgttgttgttcctttcgcaaactccttgactgctccatcaggaaatgtgatttttaccatatctgacatctttgtcactcctttttttgcatataaaaaccccgccccctatgaaagggacgaggttgaataaacggaatcgtggttccacccttttttccgcaaagccaatacggcacctgcggctctaagctctgtaacgggagttcccgtcagccattactgttccttttcaagaggttcacagctgaagttcaaaggcggtaaagcgaatggtccttagctgggaagcttgcagccagggcttccctctctttgagctggtatcattccttcgtgtccttatcaatacgtgtgtctttcttaatctcctatgtattataaattgttcaatccaaaaaatcaacacgatcgcgtttccttttttaaaccgacagccttaaatagacaggctgccggccctcatccttccgagtgcttcaccggtatttctgcatctgtaaaagcatgcagcgggagcatttccactctctcttgaaatacgttttgaatggtccttgccatcatgtgctcgggctggtcggtataaagcacgacttcatcaggcgcaatggaaatcagcggcgcgagcaaatgagaatcaatatacataggatgatcccggacaaatcttctgtctatgtatttcattttttcccgttccggcacatagcgcagctcccataatgtaaaggaaccatcatggacaatatgcacttttttgattcgcggctgtttggcgtccacatagtctctgagtgtttgaataaagttttgatattcctgttccatcttatattcatcaatcgctgcttctgtaatatctctcagctgcttatagtatgatccaagtcggaaggtctgaaaggagcgaatgtaaaatactccttcctctaaacagatcgtttggagttcatccaaaattgattgtttccgtgaaagcttcagcggctcaaacggaagatcgtctgcttcaccttcaataatactgtgtgcgagctgaaggatttgctgctgttcatcctggtccgtgaaacaataagtttcctcaatcaatgacagcatatgctcgtcttctttgcattccaaaaaaaatttgaccagaatcggctccataaaacgctgaataggaaaagccggattcgctttttcaatcccgatttttcgtatgccttcacggacaatgatattgttccgatcgtccgaatgctgaatgagatgtaaaaaagcggctgcatcatggtcatcttcaaagattatttcaagcatgtttgtccccccttacggcatctgttacaagtatatgggggatgtttttaaaatagacgtaaaggtcattggcaaatcttaatttgattcttggaacaagttttgcattttctttctgaagatgaacggcaatgagataaacacgatatacaaagcgagcaccataaagaaagcgggcagattgccagccaaaaagctcgcacccagcacattaagcgcaatcgtcccagggatgattcccacagccgttgcggcaaaatacggcagcgctttgacattggaaaggcctgccgcatagctgacgaaatcaaaattgatcggcaggattctcaaaagaaagatatagaaaaatccgttatcctccatttgcttctgtatggcttcaagcctttcgtaatgcccgttctttttcgccgaaaacaaaccagccgcaaaaaacgaaacagctgaagcgcacatcgaaccgaataacgtataaagcgtgccgagaagcgggccaaacgcaagtccgccagctattgaaataacagacaccggaaataaaacaagtggcctgacgatggatatcccgataaacatcagaggtgcaaagactccgaacgacaatacccataccctgatttctttcggcgatacattcaaatacgttttatttccccaatagagtaaaccagcacctgcaagcactgccagccatttgacagccgtttttcgtttcataccctcagttccttcccctttgaaccacagcaattatggatgtcggcggttttctccgtcaaggcggatcggagcagccaaatataatatccgctccattaatcttgcagcttttacttcttctttttctcccctctgcgaatacgtaaaatgatgcttcagctcgtcaggtgagaaattagaagaaaagaacgttggcagctgctgggacattctgtgctgaagcaccgttccgatgacctcatcccttacccagcttgtcattgattctgctccgatgtcatcaagcattaatacgggtgtggtctttaccatattgagcttctcttccaatgtctggtcttgcagcgaattcttaagctctctcacaaattcaggcacataaacaatcatggaggaatactctttttccgccagctcattggcaattgcagcgagcataaacgtttttcctaccccaaatttcccgtataaatataatcctttcccttttcccgtctcattatagcttttcaggaagtctgtaacatgctgaaacatcgcgagtctgcttgggtcactgatatcaacttgctggaacgtcgctccaagaagatcctgctggatatacatgcttttcataagagactgttgtttcttctgctggtcgagcttccgtttgactggacattcgtaatactcgatatcaatagacctcccattgacaacaagcttcggatggtagccctccaacaaattgttgcagttttcatcttccgaacaataggagcaattcttgctttgttcgatatattcataaagcttatttaagctcttttcgatcattttttggtcaatcacttcttcgttttccttcaaaaatgcttgaacatcttgatctttcatgactttttccttcatttgttcaagacgtttttggaaatccggcctgccggttacgccctgcagggaacggccgattggttccatctattccttcaccccgcatctctgtctttaataggcagagtattttttcagtttttgcatttcttccatcatctttttcttctgttcttccaaatcctgcggatgcagcttctgctgtccggattctgaatcggacgctgtttccttttctgtcatccaatcaggaagcttttcttcacgaatcactttttggtttcgtttcgaagactttgtttttccctcagcccattcaagatactggcggttttcttctattgcgagcttcatcgcttccctgaccgttttcacctttttgcgtgcccaatgcgaagcgattttttggatatagtttttcgacagcttcatgtcggttttcagcatgacataataaattaacacatttgtgacgcctggctcgagcttctgttcgaacataatttcttctatgatcttcagatcagcttttgacggctctgttccgtcagcaatgtcctgcagaagcttcttcggggaaatcgcctccagcaatgcaatcagcttcccatccagagaatcctcttctgccggtttttcgccttcacgcagatgcaccggctgtgttttttccaccaaatcgggcagctgtccgtttctttcaatttgataccagtcgctcgccgcttttcttaatgcctccgtcgtaatgacgtcacgctcatcaattgcgctcatcacaacattttgcatttgcaaagggtcaattccgtacagataagaaagctttttgattgtgtcccgcacctgctgggtcatcgcttttctcggtatcatcgtctcagaaagtcccgctaaaaacaaatcaaaatcaaacacatcctccgttatggtgtaggacggagactgtccgacagaagtatactcggacccctcggcaagccttaccgtttcctccatatcggatgtgagcttccattcactcggctgcagcgattcaaacgcatgattaaacggacgcgtaatgtccttcgcatcttctgaaatggccgggtgcgtaaaaaattgttttaattgctgatatttcgtttttccgaccctattatacagaaaaacattcagcattccgtcttcaaaaaattcatttggtctgagcggcggaaggagttcatatataaagaggcgctcctgccgctcggattctttcatatatactttcagcaatccgatgccctcgagcttcccctgttcctgatggatcgtttttaagttggactgtgtcatcgccatcagctgtctatgtgtggactctccgccccacagacggttttgttcaagctctccccacaatgtcatataaagagagaatgcaacagggccgattaagggctggtacagttgtgtaataatttgtctgtcaatatcctgcagcatcgatctgcttttaaccacatacgggtctacaggcagtacatctttccaatagtcagccatacattctcaaaccttccgaatttgtttctacctttcattttacaccgtttcttatatctatcaaatgccaattttgcacatgagaaaagagctagaagaatcctcttagctcttttaacgctctttctttattaagtcttttaattcatcgataaagacgtttatatctttaaactgccgatagacggacgcgaaccgcacatatgcgacttcgtcaatcttagccagccggtccatgaccatttctccgacgagctcactcttcacctcggagcagccttgattgcgaagttctttttcaatatcaaagcacatgtcttcaagcgttttgagtgaaacaggccttttttcacatgcttttatgaggccgcgcagcattttttctctgctgaattcctcacgcacaccttcttttttcacaacgatgagcggggtttcctccactttctcaaaggtcgtaaaccggtagtggcaggattcgcactcgcgtcttcggcgaatcgactttccgtcatccacaggccgtgaatcaaggactcgtgttccgttatgctggcatgaaggacatttcaataaaatcagctcccaactatatcgttccctgcaatgtattttcggcagcctccgccttttaaaaatagatgtgacagcatctgtcgggagagccgttgttaaatttgtttctatagcattaggtggtttgtgaaaatctccttcttattttacaaaaaaaatgaaaaaagaaaaagctgacactctcgtttctttataaaaataaaaggagcataagctaaaaagcgcataatggctttctagcttcagctccctttgtgttcgcaatttactttatagtactttcgcttgcgcctgtttaatttgcacaggccccattcctcttggtatttcaatgttttctcttgtatcagcatgtaatgcctctgcaatgtaatcagcagcgacattaggatctaagtctccacaagtataaacatcaatgctcgcatatccgtgctcaggaaaactgtgaatcgttaagtgtgattcagaaataatcacaactccgcttacgccttgcggtgcaaatttgtgaaatgcaacctcgcgcacctcagcacctgattttagagcagcatttacaaacgttttttcaataaaatccatgtcattcagcttatcaaaatcgcatccccatagctcggagataacgtgacgccccattgtttccatagtcatggacccccttaacaagaattaaaaagtgaaattccaacaactgggtcggccatttaccacgggggaaagttagtccggagaggtcctaaccctttaagtaattccgaaacagtctcaagcaagaagttcacgaaaaatagtatactgtgtttaagtctaatttgcaaggtgcgttttttcagaaatatgctgttaagggttttttctttaaaatgtgtccatgaccttattttatacagcagacggatgtttcattcgtgccgctacatggcggattagatcaacaactctgcaggagtagccccattcgttgtcataccacgccagcacctttactttcctgtcttccattaccattgttgtaagcccgtcaatgaccgctgaatgcggattcgtattataatcagtcgaaacgagcggttcatctgagtaatcaagtacaccgtacatcgacgttttggcagcgcgtttaaatgcctcgtttacttcttcagccgtaacatccgttttcagatcaacaacgagatcaaccaatgagacgttcggaacagggacacgcaaggcgaggccgtgaagttttcctttcagatgcggcagcacaagcgaaagcgcctttgccgctcctgttgttgttggaatgatggattcaccgcaagcccgcgcccggcgcaaatctttgtgcgggttatcaatatttttttggtcattcgtatacgcatgaactgtagtcatcagaccgctctcaatgccaaactcttcatccagtacttttacaacaggcgcaaggcaatttgtcgtgcatgacgcatttgaaataatgacatggcgctcagcgtcgaattggtcctcatttacgcccatcacaatggtaacgtcttcattttttcccggagcggtcaaaatcactttttttgcacctgcttctatatggcccatcgctttatctttagcattaaacttccctgttgcttcgacgactatgtcaatatcatattcccgccaaggcagctgttttggatcacggctgtttaacaaaagcactttctttccatttacgatcaggctgtcttcaccagccacaacctctttgtcgtatctgccgtgaattgtgtcatactttattaaatgagccagcgtttctgcggaatagctggcgttaatggccactacttgaatttgatcgtctaacatcgcttttctaaaaaccattcttccgattcttccaaacccgttgatcgctacttttaccttcatgttggacaccccttatcaattatgccatcctaatttgttactatctaaaattagtataacacattaaaacaaattcgccagtacatattgataaaaatcaacgattataacgctaatttatgatgcatcttatgttttcttgcacagaatatcaggcgtaagaaccaaaaagcagccagcgctccgcactgactgccctcatgctttatgattcctgttttaacttatcattgagcacactttcttctagcacagaaaatgtatccccgtatactctgttaatatgattcgctccccaagcacacagcatatctaaaattccttctaagctgcggccgtattcgctgagctcatattccactttgggaggaacttgattatatacgattcggttaatgacaccgtccgcttccagctcgcgcagctgctgagtcagcattttttgcgtgatattgggcattaggcgttttaattcgcttgtacgtttttttccgtgcgtcagatggcataaaatgacgcatttccatttccctccaatcacttcaagagtcgcttcaacagaaatgttatattttttcttctccatacaatccattctcctcacaggcaccaaaaagtgactatagcacttcaaagtacgtacttttatttcttaacgatatgtttcataatcacatttgccggctgatttgaatctgctcttttttatttatatagcttactcggcagaatttcaatcatacaacacatcttacaaaggaggaacatcatgacttcagccaaaagcagtattcctgcactactggctttggccgtaagtgcattcgcaatagggacaactgaatttatcagtgtcggccttttgccgctcattgctgatgacctgcatattccagtcacgacagcaggattaaccgtttccctttatgcgctcggcgttacatttggggcacctatattaacttcattgacctcaagcatgtcgcgtaagacactattgctttggatcatgtttatttttattgccggtaatacgatggcagcaaccgcttcaagcatcgggattttactagcagcacgtgtgatatcggcattttcgcacggtgtgtttatgtcgatcggttcgacaatcgcagcggatattgtcccggaagataaaagggctagcgcgatttcaattatgtttactggcctcactgtggcaactgtaaccggagttccttttgggacatttatcggccagcagttcggctggcgtttcgcctttatggtcattatcgccgtcggaatcattgctttcattacaaatggtattcttgtaccgtccaaattacgaaaagggacgaaaacaacgatgcgggatcaattgaagcttgtgacaaacagccggttattgcttttatttgtcattacagcgcttggatacggaggaacattcgttgtgttcacgtatctgtctcccctgcttcaggaagtaacaggcttcaaagccgggactgttgcagtgattctgctcggatacggaatagctattgctatcggcaatatgattggcggaaagctgtcaaaccgaaatccgattgccgctttattctatatgtttatcgtacaagcaattgttctattcgtactgacatttacagccccgtatcaaacagcagggctcattaccattctctgtatgggattgctggcctttatgaacgtgcccggccttcaggtgtatgtcgtcatgctggctgagcgttttgtcccgagtgcagttgacgtcgcatccgcgatgaatatcgctgcctttaatgcaggaatcgcgcttgggtcataccttggcggtgtgatcaccgattcaatcggattgattcataccgcttggataggcggattaatggtggtcggtgcagtcattttaacaggctggagccgcttaatggaaaaacgagatcggcaggaagcctgacaattttaaaggaggaaatgaacatgacaacacatttacaagcaaaagcaacacttcataatggggtagaaatgccttggttcggcctcggcgtgttccaagtggaagaaggatctgaactggtaaacgcagttaaaactgccattgttcacgggtaccgcagtattgatactgcagctatctatggaaatgaagctggcgttggagaagggattcgggaaggcattgaagaagcaggcatttcaagagaggatctgtttatcacatcgaaagtatggaatgcggatttaggctacgaagaaacactcgccgcgtttgaaacaagcctatccaaactcggtctggattatttggatctatacctcatccactggcctgtagaaggaaagtataaagaagcttggagagcgcttgaaacgctgtataaagaaggccgtatcaaagcgattggcgtaagcaacttccaaattcaccatcttgaagatctgatgacggcagctgaaattaagcctatgattaaccaagtggaatttcacccgcgcctcacacaaaaagagttgataagatactgccaaaatcagggcatccagatggaggcttggtcacctttaatgcaggggcagctgctggatcaccctgtattggctgacatcgctcaaacatacaataaatctgtcgcacaaattattttgcgctgggatctgcagcatggcatcattacgattcctaaatcaacgaaggaacaccgcattaaagaaaatgcaagcgtatttgactttgaattaacgcaggatgacatgaaccgaatcgatgcactgaatgaaaacttgcgagtcggtcctgatccggacaactttgatttttaatggcaaaaaaacaccgttcaatatgaacggtgttttttgtattatgcccagctgttcatgatttcatcaagctgccttttggtctcttcaagcgtgccgctgttatcaatgacttgatctgctcttgctgttttttcctctaagggcatttgagagcggatacggctgactgcttcttcttccgtcagctgattgcgcttcatcagacgttccagttgaagctcttttgtcacactgaccacaataattttatcaaccaatgattccaatttgctttcgaacaatagcgggatatccaatacaacaaatgcctcccgatttgcaacggcttcatcacggcgattgagcatttcctgcctgactgcgggatgaacaattgcatttaaagcgagacgcttttgttcatttgtaaataccagcgctccaagcttttttctatctatatcgccatttgagagcagtatgtcttcaccgaattcgtcaatgatttgccggtaggccggcatccctttttctaccgcttgttttgcaatgatatctgcatctataactgttattcctttttcaatcagcatattggctaccgtgcttttgccgctagctattcctcccgttaaaccaatgactaaggtcaagagatccactcctttttacaatttccagagcccaatcgtgattaacagaagccccggcaaaaacgccattttatcgatccatttccacttagacagaaaatggccggcattggttccaattgatacaaacagcgagctcatgattgccacggcgatgctcatcacaatcggtgaaaaaccgagaatggctgcgcctatgcctgctccaaaggcatcaattgataaggcaaatcccaataagaccgcctcaattccattgatcacacccgatttgtcgatatccgcactcatgggttttctcaaaatatgaatcacaatccctaatgaccgaacctctaaattaagcagcgttttttcatgcaataggtattctttatcttttgccggtttgaagaattggtacagaacccacgcaccgattccaaccaatatcaaaccgccaagcttctccgtcacatatacaggaaaaaacttcgtgagaaagcttccgatcagcatggatataaacatgacagcaccggaacagcaggcgataaccaaaatcgctttaaacggtattttcatttttctcaatccgtacgtaaatccgactgaaaaactgtccaagctgacagccaacgccagcagcagtatagaaaccatttgcatatccgtttcttcctttctgttggtgctcttgtatcagatgtgaaatgcccgggattcatcacaatcatatatatgggaaagtgaaaaatccgtgtttcgaaaatggcatcctccattacagagttactgatatatgcaccgacagcttggacgatgaagcattatgctacttttttttctggcactttgcgcaaaaatgcgtgcctcttcctccaacgacaattttcgaaatcatcgttccgcaatttttgcatggctcgtctttttttccgtacacaaaatgctgcagctggaacattccgatttccccttgggagttgatatatgaacggactgtgcttccgcccgcatcaatcgcctcctgcagagtgtttttgatttcagcgtgaagggttttgattgttttatctgataattgatttgcttttatctcgggatgaacacccgctctgaaaagagcctcatccacataaatgtttcctagtccaactaccgttttttgatccagtagggcagttttgacagcgcggtttgttttcgcaagccgttcttttaaatacgcactcgtaaattcttctgcatccggctccggacctaactgagaaagcgggagctcgcccgcttcttctcccggtttaaataagtgcatggttccaaatttccgcacatccctgtaccggagctgggttccatccgtcatcgtgaatatgacatgcacgtgtttatcgtcaggctcctcggcttgatgaagaccgtattttccttccattcgaaggtgagaaaccataacataatgatctaaatgaaacagtaaaaactttccccgtcttccgatggactgtatcgtttctcctgctagttttcgcgcaaattcctccggttcggcaggccgtttgatgatattcggccatctgatctctaccgatttgattgtttttccctttacaagcccggtcagagtgcgccggaccgtctcaacttctggtaattccggcacatccatcacttcctatctctgtttatttcgcatcgtaccaagatgggcctgatgcaaagtccacctttaacggcacatctaatgcaagcgcatgctccatcacttcaggaacaagcttttcaagaatttcaatttcttcctttggcgcctcaaaaatcaattcatcgtgtacttgaagcagaagccttgctttcaactgtttttctttcagcttggcagccatgtcaatcatggcttttttgataatatcagcggcgcttccttgaatcggcgtattcatggccgtccgctctgcaaaacttcggatattaaagttccggctcgtcagctcagggatgtagcggcggcgatgcataagcgttgttacgtatcctttttgcttcgcttcctgtactgaatcttccatgtacgcttttacgccttggaagctttccagatagcggtcgataaatgctcccgcttccttccgggtaatgccgaggttctgtgacagaccgtaatcgctgatcccgtaaacaatgccaaagttgaccgctttcgcctggcgtctcatcgcagatgtcacttcatccttagcgacatggaacacatccattgccgttttcgtgtgaatatccatatcatttgtaaaagcttcgatcagattatcatcctttgaaatatgggcaagcacccgcagctcgatttgtgaataatcggctgcaaaaatgagccagtctttttcagacggcacaaaagcttggcgaattttccgcccttcctcaagcctgatcggaatgttttgcaggttcggatcagtcgagctgagacgaccagtttgcgttaaggcctggttaaatcgcgtgtgcactttatgcgaatccggtctcgtcacctttaaaagcccttcgatatatgttgattgaagcttgccaatttgtctgtactgtaaaatatagtcgacaatatcatgcttgtcagccagcttttcaagcacatcggcagacgtagaatagcctgttttcgttttctttacgacaggaaggccgatcttttcaaataagatgacgcctagctgtttcggagaattgatgttaaacggctctcccgcaatctcatggattttttcttcatattccttcagcttcgcacccagttcttcacccatccgttttaaacggtcaacatcgactttgacgccagttgattccatttcgccgagaataagcgcaagaggcatttccagctcttcaaacagttcaagctggtcgttgttttccagctcctgaacgagcttttcccgaaggctttgaatcgctaacgctttgcggccaaggtgctcagacagtacgtcttctgacggcactgctcgttttgctccttttccataaactgattcatcacttgaaacgatatgcaagccgtaatccttagccacactcgcaacgtcgtcatatgaattgcccgggttgatgatataagccgcaaggagcgtatcaaactcggctcctttcagctcaatgccctgccagcgcaaagcgacaacagcccgcttgctgtcgaagacccatttcttctgctcgtcattttccacccattctttaaacacctcagactcaacggcagtgtctttcggaatgaaataagctcccttttcatttacgatcgaaaatccgagaatcggctcttcatgataattatcgccaatctgttcaacgacaaatgcggatggagaaaccaatatatcgcttgtcacgtctgtgactgttttgacattaatgtcttccaacgattgatcctgttctgcttctgcactgtcttctccaagccgttcaagaagcgtgttgaagccaagatctttaaagatggcaatgacctgttcacgattaaagccttgatattccaggccggaaacagatacctcaatcggagcatccgtcataattgtcgcaagctccttgctcatcaatgcttgatccttaaactcctcaagcttttccttcaatttctttccgctcacctcgtcaatggactccagcagcttttcaacggaatcaaattgttttaaaagcttaatcgcagtcttttctccgacgccgggcacacccggaatattatctgaggaatcgcccatcagacccttcatgtcaatgatttgttcaggcgtaagcccgtatttctctttgacatgctccggtgtgtaaaattcaacatcggtaattccctttctcgtaatggcaactgtcgttttgtccgttgccagctgtgttaaatccttatctcctgagaaaaccttaacttcaaatccgtctttttcagccgatttggccagtgtgccgataatatcatccgcttcatattgttccagttcatagcggctgatctggtaggcatccagcagctcgcggataaacggcatttgttcggaaagctcaggcggggttttctgtctgccgcctttatattctttaaatgtgccgtgacgaaatgttgttttcccggcatcaaacgcaaccagcatgtgcgtcggtttttcatcctcaagcattttcatcaaaatcatcgcaaagccgtatacggcatttgtatgaacacctttatcattgcttaacagcggcaatgcaaaaaacgcccggtaagccagactgtttccgtctacaagcactaatttttttcgttccgtcattcaatttcctcctaagaagcctcaggcttccattcatctcttacatagtcattagctcctcttattttaacaaagttcaatttgaaaggaaaatacgtgaactataagagaagacacaaaaaaggacgggaacacaaataggttcccgccgtcaaaattggctccttggatgaaggggttctactacatcctaccagcataggtttaacagtgcatgaagatattgttaaacctttgtaaacattaggcggacttttcagcggcccgtttcagcgtcacggtaaagacagttccccgtccaggctcgcttgtgacatcaattttcccttcatgagcctctattaaatgcttgacaatcgcaaggcccagtccggttccgcccgaattcctgcttctgtctttatctacgcggtaaaagcgttcaaagatgcgcggaatttcttctttctgaattccgattccagaatcagcaacctcaatctgaatgtctttttctctgggctttacattgatagccacggagcccccctcaggcgtgtaggttaacgcattgtttacgagattaagaaatacctgtttcagcctgtacgggtcaccagatacatattgagggtctttcggggcattcagttgcaaggagatgcctttctcatccgccttatgcttcagaagcgtttcaatctcaccaagcattttggccggctcaaacgtttcgatactgagcgtgaaattttgctgctcgatttttgagagatcgagcaaatcctgaaccaaagactgaagcctttcgctttccttaagaataatagagagaaattcagaaagcgcctctttgtcttccatcgccccatccaataacgtctccgtaaacccttttatggacgtaatcggtgttttcagctcatgagaaacattggccacaaaatccttcctcatctgctctaatttctttgtttccgtcatgtcatggaaaacgagcacaattcctttccattcatcgtccggccccataatcggaacgccgtccacttcaaaataacgccgttctattttgatcggaagtcttaacagcttgcatttctttgtctccgtcataaaaatgtcttcgacaagctggatcacttcttcatgttcaaatgcatcgtgataaagacggcgcagcatatgattcggattgatatgaaactgcttggcgtaagatctgtttacgagattaataaagcctcttccgtcgatcataatcagcccggagccaatgttttcaatgactgtcagcagccgatcccgctgcatttcctgcgttcgcgtcatttccatcagatcaatggcaaggctgttcatcgcatgtcctagcttatcagaacgcctaatatagccgccgtacgtccgtgcatcgtagttgcccttagagagttctgtggctacatttgtcgctgactcaattgaccttttataacgtgaggtcatgctggaataaaaataaacaatgacgataaatgcggtacaaagactggccgtcagcatcccccacaattcgccttttaagccgtcgcttttttcagaggcggaaagcagcacatatcctgttttttccccttcgcttctaagtgaaagtccgtaataaagcttgttatctgttgttgacagaataccctcatggccagaaacaagcgcctgcaccttttgggaatcagccgctctcccgttagacccatacagcaccttgccgtctgtatcgataacggatgcgctcacatcaagcgcgccgcctgcatctttaatgattttctcatttgtttgattattcagattgccggcatcaagaagcgaagccaagtattttgcttctttttcaatgtgttcctctgctttcctttgatcagatgtttcaaaaagctgctgtaaaaacagcccgagaacacaaaacaccagaatcatacagacaacgaatacagaaaaaaggcgcacacggtatttattcattcatttttggctcctccagtttataccccaatcccctaatcgttttaatgtagatcggttttttggtattgttttcaattttgtcgcgaagatggctgatgtgcacatcaacaattctcgtatctccggcaaaatcataattccagactgcgctcagcagcagatctcttgtcagaactctgcctttatgtctgcctaaatagagcagcagttcgaattctttcggtgttagttcaagctgactttctttaaagtacgcttcataatgatcaggcaggattttcagatcgccgattacgatctggccttccatttcatcgttcttcatctcactagagggcgcagctatttccgaacgccttaaaatcgctttgactctcgcatttacttctcttggactgaacggcttggtcatataatcatcagcaccgagctcaagccctaatactttgtcgaattcctcatccttcgctgtcagcattaaaatgggaaacatcagtttttgctgtctcagctgcttgcatacttcgattccgtccaattttggaagcatcacatcaagcacaatcaaatcaggcttctctgtttccgcttttttgagtgcttcttccccatccgaggcggtaatgacatcatagcctgaccgttccaaattgtactgtaaaagagtaacaatagattcttcatcatccacaactaaaattttcttgttcatgctgtgcctccagtattataattccccgacatcctatttctctattttatgtcatcttaacatgtttcatgattttattttagcgaaagcaggacattccgacaattcgccttttacatcatttttaaaagaaataaagacgtttatgataacgctttcatttatagtaaaaagagaaaggctgtattaagcaagcctttctctctttttattaggataatactttcatgacatttttgacagattcaactgatttattcagctgcgctctttcatagtctgtcagttcaagttcaatgatttgctcaagaccgttgccgcctacaattgtaggaacaccaaggtagatgccttcatagccgtattccccttcaagataagcaattgtaggaaggacgcggcgctgatccttcaagatcgcttcgaccatttctgtcagagaagccgcaggcgcataatacgcgcttccgtttccaagaagattcacgatttcgcctccgccttttctagtgcgctccacaattgcgtcaatccgttctttcggaataagagtttcaagcgggataccgccagcataagaataacgcacaagcggcaccatatcgtcaccgtgtccgccgagtacgaaaccagtcacatctttcactgacaggtttaattcctctgccacaaatgttctgaatcttgccgtatcaagcacaccggactggccgattacacgctctttagggaagcctgattctttgtacaccgcgtatgtcattgcatcaacaggatttgtcagcaccacaataatagagtcaggagaatatttcacgatttcccgcgtaacgcttctcataatcttttcgtttgtagagaccagatcatctctgctcataccaggttttcttgcgataccggctgtaatgacaacaatgtcagagccggctgtatcctcgtaattggatgttcccgtaatttttgcgtcaaagccttgaaccgggcttgcttcaagcatatcaagcgcttttccctttgtcgggttctccaattgcggaatgtcaacaagaacaacgtctgccagctctttttgagcgattaaaaatgcagttgtagctccggtaaaacctgctccgataacagaaacttttttacgagtatttcccatgtctctcttctcctttatggctagttttaggctttttccttgcttagtccatgtttttgatcagttcttctccgaactctgaacatttcacttcagtcgcgccatccattaatctagcaaaatcgtaagttacgactttggaagcgattgttttttccatagatttgataaccaaatcagccgcttcgttccatcctaaatgctcaagaagcagaacgcctgaaagaataactgaagatgggtttactttatcaaggcctgcatatttaggagccgttccgtgcgtcgcctcgaaaatcgcatgtcctgtttcgtagttgatgttcgctccaggagcaatgccgattccgccgacttgcgcagcaagagcatcagaaatgtaatctccgttcaagttcattgtcgcaacgacatcaaactcgtttggacgcgttaagatctgctgaaggaaaatgtcagcaatgctgtctttgataatgatttttcctgctgcttccgcttcgctttgcgctttgttggcagcgtcttttccttcttcttcagcaatgcggtcatattgagcccatgtgaagactttatctccgtattctttttcagcaagttcatagccccagtttttgaaggcgccttctgtgaacttcatgatgtttcctttgtgaacaagtgttacagatttgcggccatgctcgatcgcataatcaatggcagctctgaccaagcggcttgttccttcttctgaaacaggcttaatgccgatacctgatgtctcagggaaacggattttattgacgtttaactcattttgaaggaagctgataagcttttgcacttcttcagagccttttgcatactcgatgcctgcgtaaatatcttctgtattttcacggaagatgaccatatcagtatcttcagggcgttttaccggtgacggcactccagtaaagtatcttacaggtcttaagcagacgaataggtcaagctcttgtctgagcgctacgttcaaagaacggataccgccgccgacaggtgtcgttaacgggcctttaatcgcgatgaaatattcgcggatcacatctaatgtttcagcagggagccactcacctgttttattataagccttttctccggcgtaaacttctttccatgtaattttcttttcgcctttgtatgctttttctactgctgcttccaaaaccttcgaagccgcgttccaaatatcaggaccggttccgtctccttcgataaatgggataatcgggttgtttggtacgtttaatactccgttagagactgtaattttttcaccttgtgccacaataaaaacctcccagtatgtaattcatatttagaaaacattttatttttcttatatagaaaataaaatgatttttcctaacattcaatttaaagtgtaacccaattttgatgttctgaacaagaggctaacctcattgacgcaagccagcctccaatggttctttaggctctttcttcaatcggaacgaatttttgtttgtcagggcctgtgtaatctgcccgcgggcggatcagacggttgttgtcatactgctcaagaatatgagcgagccagccggacattctgcttacagcaaaaatcggtgtaaacaaatcatggtcaataccgaggctgtgatatacagaagccgaatagaaatcaacgttaggcggaagctttttctctgatgtgacgatgtcttctatacgaatcgacatctcataccatttgctttcgcctgtcaggttggtcaggcgcttgctcatttctttcagatgcttcgcgcgcggatcaccatgcttatacacacggtggccgaatcccatgattttttctttcttttcaagtttagcgcggatgtacggctcagcgttttccacttcaccgatttctgtcagcattttcataacgccttcattcgctccgccgtgaagaggccctttcagcgcgccgattgctgcagtaatgcctgaatagatgtcagaaagtgttgcgacgcagaccctcgctgtgaacgttgacgcgttcagctcatggtcagcatgtaaaatcaatgctttgttgaaggcttcaacttcaattggtgaaggctcttcaccgtttaatgtgtaaagaaaattctccgcaataccgtaatcttctctcggttcaacaggctcaagacccttgcgaattctggaaaacgctgcaaccaggccaggcacctttgcctgaaggcggatcgcctttctgtagttggcttccgggttcatggtatcagcctcgctgtcaagcaggcctagtaatgaaattgctgtccgaagagcagccatgggatgaacattttcgagggaataagatttgaagtgctcaataatttcttgcggaacggcagcttcctttgcaagctgctgctttaactcttcaagctcttttttgtttggcagccttagatgccaaagcaagtagatgatttcttcaaaacttgcattctctgtcaaatcatcgatatcataccccacatatgtaagggtatcatcaataatagaactaacagatgatgttgttgctacaaccccttcaagaccgcgtgtcgctgtcatatataacatctccttttcaataaatttcccctttaagagtgttgtaaaaacatgaggcttacttaaaaagcacgatgcaagtatttctctcccccaaaaagaaaatgcttacattttactggctgctggaactaaaaccctttgcttatgaaagaacataacaaattcttataagcttatttaagtttaagcctattctcattataaacaataatcagacatttgttaaatgtttacctataattttttttttcattctgtgatttccccgaaaaaacgcctttatttgcgggtttttgcataaaaaaaaagcggctttaaggccgcttttttttatgaagtgaacagttttacgatctgcatggctaaataagcaatccccgctccgatcagcggccccaccgcaactcctccaaaaagcgcgactgcaagaatggtcccgatcacgagagcagttgtaatatgcggatcattttcaagcagggccaggccgttttttgcaatcagcgccactgcgatccccgctccaagggcgatccatgcgtaggaagaccgcattgcttctccaagctgcttaaatccgatttctcccgtggcaatcgggacaagaacggcgatggtaataatggtcacaccccagttaatgccttttgactggatggtcggaaataatttctgatcaagcccaacgattttgatgatcaaaaggacggatacagcaaagagcaatgattggttttttgcgataagtgcgatagccaagagtaaaattaaaaataaattcgcttgtgtaaacacatgccatccctcctttaagatgaatgtattcatattcagccgcagcgtgaatacatataaaaaataggacatgctgacgagaggaggaccgttttcgtgaatcaatcttatatcactatttttttcagaaccctctttgtcatatcaatgaccgcagggtcgatagctgcggcctattattcgtttccgttaacttatccgttcctgatcgcccttattctttcttcagtgattcatcctgttgtcgattatttggacaaagtgacaggattcccccgaacgataaatgttctgggcgttcttgctttttttctgctcgcagccttcggcgtcctcaccattctggtagccgaaatcgtaacgggaacagcctatctagcaaaaacgctgcctccgcatatcagcacgtttatttcatattgcgaaaaattgtttaccactcatattcagccgctctataacgagttaactcttttgtttcaagaattggaaacgaaccagcaggcttccatcgtcactcatatccagacactcggtgattctgccgctaaaaatgccgggctcctgctgtcccacattctagagatgatcccgagatttttcgctcttcttcccaatacggcggcggttctgattttttctcttctggcaaccttttttatgacaaaggattggcataagctgaaagccatgcttgttttaattctgccggatcgtgtgacagctaacagcaaagcaatcagcagcgaattaaaaaaagcaatgactggttttatcaaagcacaagccgtcctcgttttcatcacgatggtgattgtatttatcggcctttctctcttaaaggttgaacacgccgcaacaattgcttttttaatcgggcttgtagatcttctcccttacttaggtgccggctccgtatttgtgccctggattttgtatttatcgattacgggccagctgccccaagcaatcggaattggtatcctgtacctcgtcgttcttattcagcggcagctgacagagcccaagatactaagtaaatctatcgggatcgatccgctggcaacactcatcgccctgtttgccggctttaaattattcgggtttttaggactgattgcgggaccggctgtactcgtcatcatccaagctttcatcacaacaggcgcattaaaagaaatatggtcctatatcaccgttcagcaaaaataaaacggcagccgttttttcatggctgccgttttttatttgatgatgatccgcttattcttcgacattcctctcagccatttgaacagaatcggcttacaccagccgcgggtaaacgggataagaagacaggcgccggccaaatctgataaaaagcccggaagcatcagcaatagaccgccaatgaaaatgcacagaccgtcagcaatcgcttctcccggcattttgccatattgaagatcacgctgaaccttataatacacttcggttccttgtttttttgcagctgctgcgccgataatgccagtcagaatcatgaatagaactgtcggcaaaataccaatcagctttcctaaaaataggaatataccgatttctattgccggaaacacaataaaaagcaaaaacaaaaatctcatatccaagccccccacacgtgtaacacgttctgttcaacaaaaggcatgataaagagaaaaggaagggattccccttccattttcacctgtaattaaagaacgctcgcacggccttgatagactgcgcctctggaagcgtcaactgtaatatcctggccatctgtcaaaatagatgtcgcattttccagacccacgataaccgggatgccaaggcttaatccgactaccgcagcatggctagtcaaaccgccttcttctgtaataagagcagacgctttttcaagggatgcaatcatatcacggtcagtgcttttggtaacaagtaccgcaccgtcagtcattttttgctcagcttcttttgcattttgtgcaacgacaaccggaccgtaagctgatttgcgtccaatgccttggcctttagcgatgatatcgccgacagtatgaaccttcattaagttcgtagtgccggactcaccgacagtgccagctgtaataacgataagatcgccgtgttttacaattccgctgttcaatgatttttggacagcatcctcaagcatctcatctgttgagctcgcattttggccgctttccgcgaatacgccagatacgagggcaagctttctggaaatagagtcatttacagtaaccgcaacaatcggagcctgcggacggtattttgcaatcatacgtgctgtatggccgctttctgtcggcgttacgatcgcagcagcattcaggttaatcgcagtatgtgcgacagattgtccaattgcgtctgtaattgtcatgcccacttggtctctgcgttttgagagaatttctttataatttaatgcttcttcagaacgggacgcgatgttatgcattgtttgaactgcttcaaccgggtaacttccggcagcagtttcaccagaaagcatgatcgcatctgttccgtcgaagatcgcgtttgcaacgtcacttgcttccgcacgagtcggacgcgggttgcgctgcatgctgtcaagcatttgtgtcgctgtaataacaggtttgcccagcgcgttgcattttttgatcagttctttttgcacaagcggcacttcttcagctggaatttccacacctaagtctccgcgcgcaaccattaagccgtcagacacttcgagaatcgcatcgatgttgtcaacgccctcttggttttcgattttagggatgatttgaatatcctgagcgttgtgctcttcaagaagctcacggatttcgagcacatccgtagaacgtcgaatgaaagatggtgcgatgaagtctactccttgctcaataccgaaaacgatgtctcgcgcatccttttcagtaatacccggaagattgacacttacgcccggtacgttaacaccttttttatttttgagtgttccgttgtttaatacttttgttttgatttcgcgtttagcggcatctacatcaagtacctcaagaccgataaggccgtcatctaacagaatcgttgaaccttgttcaacgtcatggactaaaccttcatatgtcactgaaattttatctgttgttcctacaacctcgtccattgaaataatgagctctttgcctgtttcaagctcaataccgccgttttccattgtatgtgtgcggatttcaggaccttttgtatcaagcagaattccaacgttcttgccaagttttttacttgcttcgcggatatttttaattcttgcaccgtgctcctcaaaatctccgtgagaaaagtttaatcgagccacgttcattcctgactccattaatttcgtaagcatttcaatactttcacttgccggaccgatggtacaaacaattttagtttttctcatttggttcacttccttctgaaatcttcagccttcatctgcacattagatagacagttcttttgaaagctgatacatgttttgctcaactgtgtgttttgtctcaagtatttctataatatcatggtctacaagcttattgttttgtatacctacacagcgtccgccttttccttcaagcagcagttcaactgcatatgcgccgagacggcttgccaacacacggtcagcagcactcggagaacctccgcgctggatatggcccaatacagataccctagtttcaagatttgtttcttcttcaatgcgtttcccgaattcaacaccgctgcctacaccttcggcaacaataataatactgtgcttcttgccgcgttcgtggccgcgttttaagcgggcaatgatttcgtgcatgtcatagtctgcctcagggattaagatcgattccgcgccccctgcaagaccggcccacaatgcgatatcgccggcatgacggcccattacttcgattacatatgtacgttcatgagaagtcgctgtatcgcgaatcttatcaattgcgtcaattactgtatttaaagctgtatcgaaaccgattgtaaaatcagtgcccggaatgtcattatcaattgtacccggtacacctacacatggaaacccgtgttccgttaattttttcgcacccatataggaaccgtctccgccgataacaacaaggccttcaataccaagcttcttcaagtttgctatccctttttcacggccttcaactgttttgaattcaggacatctcgccgtataaagcttagtccctccacgatgtataatatcgcctactgatccgagttcaagcttttcaatctttccgctgatcaatcccgcgtatccgttgtaaataccgtaaacttcaacgtcatgatagatcgcttttctgactactgcgcgaactgctgcgttcattcccggggaatccccgccgctcgttaatacccctatacgtttcattctccattcacctcagcaacatatatgattaaacataacatgatcattgccctaaaaacaatgaaaagggatctccatcctccctatgaaaccttacctattatacaattaaataaattgtttttaaataaaatttaaggaatgtcacaaaaaataaacgtgagccaaaggcttcacgtttatttagtttaccccgatatattgatcttcaaccgagactttgccaattgctttatatttttcatagcgctgctgaactaattcttcttcgctcagcttcagcaaagtttttaacgattgtttaagggtttcgtccatatagcttgcctgcagcttcacatcatggtgcgctccgccttttacttctttaatcatatgatctataatacctaattcttttaaatccggcgcagtgattttcattgtttctgctgcttttttagcaagactggagtccttccataaaagtgccgcggcaccttccggagaaataacagaataagtagagttttccagcatatgcaaatgattgcctacacccagaccaagggctccgccgcttccgccttcaccgatgacgatacagataacaggcactcgaaggccggccatctcaaacaggtttttggcaatagcttcactttgtcctctttcttcagctgctcgtccagggtatgcccccttcgtatcaataaaacagataattggtctgttaaatttgtcagcctgtttcatcagacgaagcgcttttctgtagccttcaggatgcggcatcccaaaattgcggactaggttttccttcgtgtctttgccgcgctgatgcccgattaccgttacagggaggccgtggaacttcgcaatcccgccgacaatggcttcatcgtccccgtacgctctgtctccgtgacattcaaaaaagtcggtaaacaggtgttcgatataatcaagagttgtcggacggtccgccagacgcgcgatttgaacccggtcccatggcttcagatttttgtaaatatcatcctgaagcttagcgagacggtcttcgagccgttcgatttccgcacttagatccatatcggaatcttgggtgaatttttttagttcggcgattttggtttgcagttcaatcaccggtttttcaaattctaatcttggagccactcaatgtcacctcctgtttgatgcatatccagcagattttctaacgtttttttcatatcgtcacgatgaataaccgcatcaagctgtccatgttttaataaaaattcagccgtttggaagtcctcaggcagtttttctcctattgtctgttcaataatccgtcttccggcaaaaccgatcagcgcgccaggctcagcgaaattgtaatcgccaagggatgcaaagcttgctgatacgcccccggtagtcggatgcgtcattactgaaataataagaccctgttcttcactgaacagttttaacgcagagcttgtcttagccatctgcatcaaacttaatacgccttcctgcattctagcgccgcctgaagccgtaaaaataataaacggaactttatcagcttttgctttttcaatcgcaagcgtgattttttcaccgacgactgaacccatgctgcccattctgaatgaagagtccatgacggcgactacagccgggtgtccgccgatggtgcccttgcctgtcacaacagcctcgtttaaggatgttttctcgcgatctttttcaagcttttccagatatcccgggaaaccaagcggattttccgagagcattccctgattgaattcctcaaaggatttttcatccatcaagctttcgatacgctgttttgcgttcattgggaaatgataatcgcagttcatgcatacccgcatatttttatccaactctttagtgagcatgatttttttacacttaggacattttgtcataatgccttccggaacatcgtgcttcgcttgatcagatggtacggaagcatactttttctttttcgtgaatatatcctttaacaaatgattacctcccttttgtgaagggttctcttcaccgcatgtcatcaaacagatagacttgctaataactttaccgaaactattgtactttttttgtcaaacgctgtcatcctcaattcgacaactttttattcgatgacgtgctcggaaaggcttgtatgaaatcagataaggtgttgaaacgacaaggttgacagcgcattcaaaaataatgttaaacccggctgaaatttttttaaggctaaccccctaaaaaaatttcagccgtcagtttaacttgagaacagcgcgccggtctccgccaacgcgctgccatttttggaatgaattaaaattattcaccaataatcgtaagttttcttgttttttctgcgacttcctcagggtcaacagtgattcttgcaacacctgtttccatcgcagcttttgccacagccttcgcaacagcaggcgcaacacgtttatcaaacggtgcagggatgacataatctgcgctaagctcatcttctgaaaccagtgaagcaatggcttcaaccgctgcgattttcatttcctcgttaatatgagtggcacgcacatcaagtgctccgcggaaaataccagggaatgcaagaacattgtttacttggttcgggaagtcagaacggccagttccgataacgcttgctccggcttcacgcgcatcttccggcatgatttccggatttggatttgccattgcaaagataatcggatcttttgccatgctttgaaccatttcttttgttaacgcgcctgctacagagacaccgataaatacgtcagcatcaacgatgacatctttcagagaaccgtctttgcgatcttggttcgtgaacttcgccacttcatttttgacatcgttcatgccgttcgggcgcccttcataaatggcccctttggaatcgcacatcacaatgtcgcgaacgccataatgatgaagaagcttgataatcgcaatgccagccgcacccgcgccgtttgcgacaactttaatggatgacatggattttccagacagtttcagcgcgttcacaagacctgctacggttacaatggcagtaccgtgctgatcatcatggaaaaccgggatgtttgtttcttttttgaggcgctcttcaatgataaagcagtttggcgctgcaatatcttcaaggttgacgccgccaaatgtcggttccagcaattttacagtttcaacgattttatcaacatcgtttgtgtttaaagcaatcgggaacgcatctacgcccgcaaagcttttgaaaagaactgctttcccttccataacaggaagcgccgcttcagggccgatgtttccaaggccaagcacagctgtaccgtcagttacaactgctaccatgttccccttcattgtataatcatatactttgttaatgtcttcatgaatatccttacacggttctgcaacacccggagaatacgcgaggcttaaatctttcgcatttctgacctctacttttgatttagactccagtttcccctggttgactttatgcaggtgtaatgcttcttctcttaatgacattctcctaaacactccttatggatattttttgattcgtatactgctgcgttgattgctgcattctgcggagtaaatctatctgaatatttaaacaggatcacataattgctccaattgtataacaaaaagcgaatcgttaccactgttttaaaacgacgtttttttgacccaacagctcttttaagcgatataacacctggtgatctgcattgatatggaacgactcaggtagcttaatcgtctgtttttgcctttcataatagagataaacgcctgtttcccctttatgctccagcaaaatgcgcttaatctttgccaggatctcctggctgtgctgactgctttctatttttatataaaccgatggcgctttttctgcatccatatcttctaataattctgcccgggacatgatgaattggatcttatcttgtctaacttcacatttccccgcagtgaacaaaagagcgccttctcttaaaacgggagaaagctgtctgaattgttcagggaagactacggcttctatctcgccggtttcatcactgagcgttaaaaacgccatgttttgacctgttttcgtccgaatcgttttgatcttcgacagcagaacgcctagtgaaagctgccttttgactgcccgctgagcctgcagaatagagactgctccttgcgcagtgagctgttttcggaaggcggagaggggatgatttgaaaaataaatgccaagcgtttccttttcaaacgcaagtaaatccaccagaggaagctcctccgtctccacatacttcggcttaattgaaaacgattcatctaaaaacaatcccatttggtcatcgtccgcggcgaatagctcagcatgttccaaagcaacatcaatggatgcgagcagcgtggcccggttttggccgaattcgtccatcgcaccagaaaagataagtgcttcaagcattttgcgatttacgctttttgacggcacgcgaaagcagaaatcgaaaagatcttcaaatggtttctcttttcttgctttatatatatctttgactgctgagacgcctacactttttatcgcgcggaggctgtatctgacagatccgttttcaactgtaaacggaaaactgcttttattcactgacggaggaaggatacgaatcccgctcccctttgcttcgtaaagatattgagagattttatcctcattgccaatgacgcttgtcagcaatccgcacataaaatataacggataatgagctttcaaatacgcaagctggcacccgatcatgctgtatgccaccgcatggcttctgttaaagccatagtttgcgaatttgacgattaaatcgtagacctcatttgcagtgtctacagaatactccttttttaagcacccttcaacaaaatggcttcgctctctgtccaggatttcttttttctttttgctgaccgcccttctcaataggtccgcttcgcctaaagaaaaccccgccatacgggaagcaatcatcataatttgttcctgatacacaatgacgccatatgtatcttccaaaatgctccttaaatcttcatgaggatagtgaacaggcgcccggccgtgtttacggtcgataaataacggaatattttccatcggacccggccggtacagtgcattgaccgccacaatatcttctaggcccgaaggtttcagccgtttcaagacgcttctcatccctgcagattcaagctggaaaatgcctgtcgtatccccttttgacagcaaggagaacgttttgtcatcgctgtaggaaatacttgaaaggtctattttaatattttcttctttttcaatcattgaagtgatggattcaataagtgtcagattcctcaaacctaagaaatccatttttaaaaggcccaagtcttcaagatggtccatcgcgtattgcgttaaatagatcccttcatgcccttcttgaagcggaacaacatctgttaacggttcttcactcaggacaacgcccgctgcgtgggttgatgcatgccttggcagcccttctattttccgggcaattgaatagacttgctgaagcaggcttgactcccgaagccgcttatccagctgcggtgactgctgtctcgcttcatccagcgtcattcccggtcttgaaggaatgagttttgcaagctgatctgcctccttcgggctgacgccgaatactctgccgacgtcccggagcgccgcctttgccgcaagtgttccaaaggtgataatctgtgcgacgtgcattgcaccgtatttctgctgaacatattgaatgacttcatcccttctagtatcgggaaagtcaatatcaatatccggcatgctgacgcgttcgggatttaaaaatctttcaaacagaaggtgatgcttaatcgggtcaacatctgtgatatacagcacgtatgccacaagagaacccgccgcagaaccccttcccggtcctgtaacaatccctttttcatgggcgtgcttcataaaatcccacacgatcagaaagtaatcgctgaacttcatccgcttgatgacatcaagctcatattgaagacggcgaaggtatcgttcatcaggcttgccgaaacggctgcggagtccctccatacagatatccgttaaataatcatcagcggacgttccgtctggggtcggaaaagacggtagacgggtctgcccgagactgacgtcaatgcggcattgttccgcgatctctacagaagcttgcagtgcctcgggatgctctcgataaatgttttgcatttcttcgtgtggtttcaaatcgagatcaggcaaatcttcagcgggtgcatccgtcagtttttcccccgctttaatcgctttcaaacaacggtaggcagccttatcttccttccttatgtaatgcacatcgcctgtggccgtaacagggatacccgtttcttctgacagctttagaatctgctcagacaagacttgattccctttaaaaggctgataggagaaataaaaagctccctttccgaatatagactgaaattccagcgaggcttgagcagcctgttcgaacagtcctccttcaagaagcgtttcaatatatcctttttcgccgggcgttattgcgataatcccttctcgataactgtgaagccatttcggcttcagtccgccttttgatttagattgcagaacgctgctgattttcagcaggttttgatagcctgtatttgattttgccagcaggacgagcgggtatgcttcaagttcgctgtcatctgtaaaaacagaagccgtcaaaccgattattgggttgatccctctcgtcttgcaagctttgtaaaattgaatagctccgtacatgacatgatcatctgtcagcgccaaagacgcatatccgagcctgtcagcttcactgacgagctcttccacagccgcggcgctgtttagcaggctatacccgctatgcacttgcaggtgaacaaaagacatgctatcacctctttctcattacgattcatttcttccctcattataaggccggtttccaaaagaaacaaatgttcttttttgactcatcatcatacttgtcctgaaagctcaatatgatataaaaggtgaggtgataaagatggatcaggaagcaggatttatggtgaattttatcaatagctacttcattgcgttaggggtgctgatcgggggcgcactcattggagggctcggagcatatttggcaggcgaacccccgcttacagccattacaaagcttgccaaccggttaaaaatatgggcgcttgtcgcagctatcggaggcacctttgatgcggtatacagctttgaacgcggcatactcgaaggcaatacgagagatatctttaaacagcttcttttaattatttcggccatggggggcgcgcaaagcggctggcttattatatcatggctgacccaggagcatctttcttcatgagggtcccccagcattacaaaaaaccgggatggcagcgttttttcgcgggaatgatgtgcggagccgtaatcagctggttctttttcctgtttacttacggaacattccaagaggagcaggtcagcctcatcgaaaagcaaaaagagcatgtaaaagacttgaacaatcaaatttcgatctatcaggaagacctccataaactgaatgaagataataaaagaaaactgctgattcaaagcgtcagcgtcaaattgctgaatggggataaatataaaatatcacagccggataaaacgaaattcgaggagcatgtaaaggatgatatttcagaggtgattacaaaagacatagagagcgtctatcaaacaaaggatctcttgaagcggacaattgaaaataaagtctatatgatcaatgaaaaaaaatacgaggcaaccgtcagagaattgattatttatacgaggctgacagtggaacttgaaatatctttcgccacataattatggatttttttcaaattctccaaacttctgtcgctttttcccattcttttttataaactatatgtgaggcttaatggcgaaaggaaggaggaagggaaatggaggtttacagtgaccgtcagttagcaaaagatcaagcagcccgtctcagacaaggtttttctgcatatgccgaaacaaactcactcgcttccctcatcaaaaaagaacttcaatcacacaatctccaagtctacgaggaccttactgatttcggctgctggttcatccccgtcacagatgaacactaagagagagggtctcccctctactcgtgttctttacataatgtttccagatcagctaaaatccgatcagcttcatcccagctgtaaatagaggcgcctgaagctaacggatgccctccgccgttatatttccgggcaagtccgttaatgacaggccccttcgaacggaatctgactctgatttgatcgtcttcttctacgaaaaacacccaggcgcgaatacctgagatattgccaagcgtcccgacaagctgtgacgcttcagaagccgttgtgccgaatttttcaagcgtatcctttttgatgaaaacagaagcggccccgttttcggacaaagacacattttgaaagataaagccgttaagcttcaccacattcagttttgtttcatacaattgattaaacaactctgaggaagagaatggatactgaatgagctcgcctgcatattttaatgttttttccgtggtattcggaaataaaaagcgtccggtatctccaacaatgccggcgtagatcagctctgccgctttcgtattcagcttccagccgtgctcttttccttctaaatacagctcgtaaatcatttcacttactgagctggcgcttgtatcgacccagagaaggtcaccgtatggatcttcgttcggatggtggtcgattttcattagtttggcgcctgaaggataacgctgatcgtctattctttcctgatttgccgtatcgcagacaatgacaagtgcgccttcatatgtttcattgtccacctcatcaagggaatataagaaagagagggacggttcaggcgtgccgaccgcaaaaatatttttttcaggatatgtttcacgcaggatttccgtaagcccgcactgtgatccgtaggcatccggatcaggacgcacatgtctatgtaagataatcgtgtcatataatgatatggttctgatcaattctgttttcatttgatactcctttattgtttttattcattaaatcacattctctgccgacggaaaagaaaaataacgtcaaaaccaagcccgtttttgtataaaatgggtttgtaaacttttacgatggaggatttcatttatgctggttcttgtttttttgattgggctttccgcctgcttttatgtgtactataaagtaaaaggcgtacgggcaaagccatctttggcaaaagaaatatgttcagcaaaatcaagcatggccttagggtcactagtcctgttctacgggctcaaccaaatgatattattccattcagtattaacgttaataatcggcggtatctttatcgtcataggagcaggaagcgcttgggcaggttataaagcctttaggcattacaatccccttcacgccaaagaagctgaaagagatcacgcgtaaggggcgcctgaacgtcccttagcttctttccatcagctgaaccatcagcatcgctttagacacgatatgaccttggctgtgcacttccacttccattttcccgaactttctgccagcctccaagatgcgaggtttgacttcgatgactgattccatctgcacaggcttcaaaaagaagatggtgatgctctctatgacgagttcgccgcgttttttcgagcgcaaaaatcggtttgccgcttgcgtcaaaatggtcgtaaatacgccataagaaatggttccaagctgatttgtcatttgcggcgtgacttcatactcgtaaaccgtttgatcttctttatcatcaccctcatctttaaacccccttgaaacgatatcatcaagcttctccccgacctgcggctgcttttgaatcatttgaagagctttcaatacgtcttggcggctgatcatgccgatgagtttttggtggccgtcagtgacgggaagcacttcgatcccttcccataccatcatttgcgcagctgaagcgacagatgttttcccaataaccgtgacgggatttttggtcataactttttctatagatgcatttcggtcatggccagcaatatcttttgatgtcagaatgccatggattttcatttgatcgtcgacaaccgggaagcggccgtgccccgtttcaaaatttttctcataccatttttcaagtttatccttaggcgaaagatataccgtgcggtcagcaggtgttaggatgtcctccaccaaaacaatttcttttttgatcagctggtcatatattgcccggttaatcatcgcggcaactgtaaaggtgtcatagctcgtggataaaatcggcagttcaagctcatctgccagctgcacaatgctgtcatccgtgttaaagcccccggtcaccaatacggccgcgcccgcttcaagcgcctgcctgtgtgcattgattctgtttccgacaatcaaaagattccccgctgcggtgtaacgcatcatcgcgtcaagctccatcgcgccgatgacgaatttattcaatgtcttatggagccctgccctgcctccgagcacttgtccgtctataacatttacaacctctgcataggtaagcttttcaatgttctcttttttcttttgttcaattctgattgtgcccacacgttcaatcgtgctgacaaaccctttattctctgcttccttgatcgctctgtacgcggttccttcgcttactttcatttcctttgcaattcttcggacagaaattttttcaccgacaggcagtgaatcgatatacgttaaaatttgttcatgcttcgttgccaagcctttcacctctaaggacagtcttcttgtttttattataaggtttcaaaggatttatacgcaatgaggctggaaaataaaaaagaagcccgaccggcttcttacagcgttgatttcgtcccagtcaagcgcaaggaccccgtggctccttttacatcgtaaagcggaaaaacctttatttttcttttaaatggacatcaaccgctgtcttaacaatatttcgattccctattttagataaaacaaataaaactgcaaatagccatatcgcccctatggccgtatagatcaatggataaacagctttgtttgcgatccattcatttattaatgttctggcatttaccagaataataaatcctcctacaagcacacccatcaattgcggatgaaacttctgcaccagccatgctgcgataggggcagcgataattccgccggccattagtgaaaacacccataaccaattgacgtcctcccatcctaatgaaataagaaaaccggcggttgcagatacggcgatggcaaattcacttgtgtctacagtcccgacaactttcctcgggctcaagcctttgcgggataataaaatcggagtggtcaccggtccccagccgcctccgcctgtggcatctgcaaaaccagcgatcactcccaatgggatggattgttttcggtttaacggcacatgcttcttctcaagagccggcttatattgaaataaaaacctgatcaatacatatccgcccagaaggagcaaaaacaaagaaatatagggtttcgccacatctccaggtaattggctgaggaatgccgcgcctaaaaaagcgcctatagagccgggaatgacaagctgataaacggtttgtttgtcaacattgccaaatttaatatgcgacactcccgatgcggcagtcgttacgacttccgctaaatggacagaagccgaagccacagcaggtgtgatgccaaacgccaataacaaagaagttgaggtaaccccataagccatacctaacgaaccgtctattaactgcgacaataaaccaataaatgcaaaaacgattaatttcttcatcagaacaccccatctatatcaatcagatatttttgactcttcattcgaatctaacaatctcttggcgctttcatataaaaaataagaggctttgataatggcagtttcatcaattgtaaatgcagggtggtgccaatcatgatcaccgtctgttccaaaaaacgcaaaggatcccggaatatgctcaagataataagcaaaatcttcccccgcggttgatgggtcgggatcaatgacttgaagtttcgctttatgcgcagcgtctcgcaccagccccgtaattgcctcatcattacaaagcggcggcggtccggaatgccacttcacatttgcctttaacgagaatgcggcagaaatctgctctgcgactgccaaaaaacgctgtttcacttgatcacgaacctctgaatcaaatgtacgaacagtgccctcaatgacaactgtatccggaatgacattccaagtgctgccgccgttgattttccctacggttaaaatcgcgctttgcagcgggtttacatttctgcttacaatcgtttgcagggcgacaataagctgagaggcgccgacaattggatcaaaaccattatgcggcaatgctgcatgagcacctttcccttctatctttactttaaatcggtcaacagcagccataagcgggcctgtttttaaccctacagtcccaaccgcgatatccggtttattgtgaagtccaataaccgcatcaatgccatccagttggccgtcctctatcacttttgcagcgcctgcacccgcttcctctgccggctgaaataataaacgaacctttcctttcagactgtcttgattttccttcaataaaaagaccgcaccaagaagcgctgccgtatgaaaatcatgaccgcacgcatgcatgatccctttatgtttagacgcataaggcaatcctgttttttcttcaattggcaaggcgtcaatatcagccctcaaagcaatcgccggaccttctgactcccctgctatgtctgcgaacacacccgtttttagagcagtagggcgaatctgtatccccttttctttaaggcatttttttataaaagcagttgtttcaaattcttcttttgacagttcaggatattggtgcaggtgccggcgaatgccgatgagctgcttttctagcgttgagagatttacgggattatactcccctttcaacttcaggatgtcatttcctgtagtctgatatggataggagccttctatatttctccaataatccaaagacatatgtaccgctcctttccctatcccaatatattttcttcagactcttcaacataagatgaaataaatcggttcaatttatcagcaagaccgcccgccccaaatcttatatacttgctggaaactttcggattatcttctttcaaaaaacttaaaaaagataaaatataaatgcgcctgtaagctacttgtgtaattccgtactcaaaaaaccagttatcaatgacattgtatacgcctcggttgacgccatataggttgttacatttcttgtaaaagcagagatccggaagatttaactcctgatgggaaagcaggctttcttttttgttcggtgccataatcccaatcagttcaaagcgttttgcaacgcaccaaatatcctttttaatttgctttgttaaagactccaaagaatcaaaccttctttcttctctaattttaaagagaatgctgcattcgattttttctccatagatgtctctatgaaagtcaaacaaaaaaatctccaatgtccttttaaggttagagcccaccgtcggtttcacaccgatattcataacccctaaatggaattggtgattgactgtcgccagaactccataaactccattacgcagcccatgcatttttgcatctacatttgccgtggggaatccaagctttctgcctaattgttttcctttcacaaccgtaccggcaatgatcgtcaaaaaagtcagcctcctctctcagcttccgcattcgatcagacgaaacctaatgatgtgatgaatgtaaaacggattgatgctgcggaatgccaagaccgagattttcccgcaatgtcccgccgcgataatcttgacgataaagccctctttcttgaagaatcggaatcaccttttctacaaaagcatcaagtgttcccggtatatccgacccaatgataaacccatccgccgcctcagcgttgaaccaagtttcaattaaggatgcgacacgctctggtgttccgatgaatagagtccgtggaaaagccatttcctgtgctacctcccgcaatgtcagatttctggcttttgcttctctcttaatccggtctgttgtgctttgaaacgcattctttcccacatcgccaatatcgggaaatggctcatccaacgggtaaacactcagatcataatcatcaaaaaaacgagccaaataagtaacagcattttcaatcggtatcaattctgcaaattcacgatacttcttttccgcctcttcttccgtatctgccacaatcgggctgatccctggaaaaatccgcacacttgaaggatcacgcccttcatcagcagctcgccttttcacatccgcataaaacgcttttgtctcttctaatgaattggaatgggtaaaaatcgcatccgcatttttggcggcaaactgccggcctgtttctgatgaacccgcttgaaacactacaggctctccctgtttagagcgcccgatattcaagggcccctctacttgaaaatactttcctttgtgattcaggcgatgaagcttctccggttcaaaaaattgccctgttttcttattgtgtataaatgcgtcatgctcccaggaattccacagcccgcgcacaacatccaaatgctcctgcgcgatttcgtaacgctcagtgtgttcaggcagattggacttactatgattgcgcgccgccccttcctgcggcgaagtaaccagattccagccggccctgcccccgctgatatggtccagcgacattaattgtctggaaatagtgaatggctcagtaaaagatgtagagaacgtccctactaaaccaatatttttggtaaccgatgccagcgcagataaaatggtgatcggttcaaaacggtttaaaaaatgaggaatcgatttttcagaaataaataagccgtctgcaatgaaaataaaactaaacaaacctttttcagctgtttgcgcctttttcatgtaaaattcaatattcgtgctggccgagggatcaacatcgggatgacgccagccgtcagttgttcccccgacaccgtgaatcatggctccaaactgaataaaatctgaacgtgtcatctttttgcctcctttatctgtgcatgattagcaagtgcaagatcaaggtgttcaatgccgatttcagttatcccttgatagtgattgccgcgcccgatttcgaccacaggcacatggcgtaccccatatttcgcctgtaaaatatctcgaagttcctctttctctgaaacatcgatattttggaacgggaaccctttttcattcaaataattcttgacttcctcacaatacgaacagccttttttactccaaaccacaatgttcaaaacatcactcattcttctgaacctccttaacgttttgcagctaaaactgcatcgctcagcagctgataagacagctgtttttcttcagtatttttgatcggtgtaaaaataacaaaatcattgattttgtatgtgcctgataaacgtgttaattcttctgccacttcttcctttgttccggcaataatcccggttttttgcacgatgatgtcatagggctctgtgacgttttccagataggcctcagcctgttcgcgggaaccgacgttgaccttacgcccgtctttcaaatccacttttatcgattcacgcgacacaatatgtttttccgcttcttcttttgtatgtgccgcaaaaacagcgggggcaagatgaaattcagcctcagatcctggcgggagatgcgcgtcaaatgctcggcgggcttccttcagcacttcctcttcaccgttaataaagtaagcaaagacaaaagagattcccagttttgcagccgaaatggcactctctgcgcttcctcccaatagaaaaatacccggcttctgatcaacctgcggcctaggacgcaatgcggcatagcggtgggtatcaggaaaatcatcccgaacgaaatgagtaagctcctccagtttttcatcaaactgacgcaccggttttttatattcggcctgcagcgcgtctgtggacagctgaaacccgccgggcgctttgcccactccaagatctatacggccgggagctaacgctgatagaagatggaattgctccgctactttataagagctgtaatgctgcagcatcactccgcctgatgctaaacgaatttttcttgtgcttgcagcaagatagcctaaaagaacctcgggtgcagaccctgcaatctcatcattgttgtgatgttcggccacccaaaatcggtgatatccacactcttcagccatttgtgccaagttcactgtatgctgtaatgtatcagctgctgtctccccttcaccaatcaagctttggtctaaaatacttaagcggatcatatcaccggctcctttatgtgttcttttggttcaaataaatattccggcgaaacacggcggagaaactgcctcgttctgtcttttttggtatggcgaaagacttcctccggggttccttgttcaacaatgactccttcatccataaaaacaacttgatcagagactcttcttgcaaactccatttcatgtgtaacaacaatcatggtggctccggttttcacgatttccagcattacctcaagcacttcaccgaccagctccggatcaagcgctgccgtgggctcatcgaacagcagcacatcaggatgaatggcaagcgcccttgctatccctaccctctgcttttgtcctcccgataactgactcggataagcgttcaatttatcttgaagcccgacctttctcagttcattttccgctacggcatacgcgtcttgttttctcattttccgggcaatcgtcaagccctccatgacattttcaatcaccgttttgtgagcaaacaggtggtattgctgaaataccattgccgtctgttttctgagccagtgaacctcttttttggacggaaagctgcaattaatcactttgtcatgtatagaaatgatcccttcgtctggacgttctaataaattcaggcaccgtaaaaaggtggttttccctgatccgctcggcccgataatcgtcacaacttctcccttgcgtaccgtgagatttatcccttttaatacatggtggatgccaaactgtttatggatatttttaatctcaatcataaagtgcctccttgaaatctggctgcctttctctctaatactccatttgcggattctaggattagagtcagcacccaatagataatcgctgctccgataaacgcttctaaaaatgcataattatcagaagcaacgatagtcgccgtccctgtaatctctgggacagccactatagccgcgatagaggtggtatgcaaaaagccgatacccaaatttgtgaagtttgggatggaaaccatcagcgcctgcggcaatattacacgccgaaaggtttggctgtgtgtcaagccgattgaataagccgcttcgacctgtccggtatccatcgccagaatgcctgaccggatgatttctgtgagataagctccggcagttaaagacaaggccatgatgacaaacatggagaccggtatctcattggcggaccagccgagatgaaaaaaactgctgacttgatctgcaacaggaggtatccctaaataaatcaacataatgtgaaggattgcaggtgtacttcgaaagaaagacacataaaaccttgagcaagccaccaagcccttaattctaaaaattctaacaattatatttccaagagccacgagaaatccaaacacaatcggcaaaacagccatcatcaatgtcagaggaatggtctttaccatttctttcatggcggaaacgataaatggaaagtcaaattgcaatcttctcccccctcatccgaagaaatatatcaatgtatgttcatgtcaaaaacagtaacaatccttgtttgattcttcttgattcgtttttctgccactcgaaagaaccattcgaataaaactgcaacagcataataaacaatcgatagcgcaatgtaaacttcaagagaatggttgcttgaggtaatcagtgtttggccccttccggacatatccataacacctattgaaaaagctagagatgtatcttttaaagaactgatcaccatgtttcccatattcggaaatgcctggacaagtgcctggggcagaacgattcgcctgaaggcctgactaccgcttaagccaatactgtacgccgcttccgtttggcctttatctacactgcccacccccgctcgaatgatttctgcggctgccgctgcattgcttaacgcgtaggttgcgacagcagcataaaacgggtccatttttgatgtatcaatcccgataagtcccgtaagcgccgggattccgtaaaacacgatgaaaagctgcaccatgataggcgttcccctgaaaaatgagatatacacttttgccaattgatttacaattggaatattgtagatgcggggcagtgccagaaagagtcctaatacaaaaccgaaaagcaaggacagtgttaaaatgtataatgtaaccggtaaataagcggttaacgtcggcacaaaatctccaatcatgttcatatcaaacgctttttccatcactgctccctctcttttcacctaatactgctctttggaatagtcgtcaccaagccattttaaactgagttttttcagcgttccgtcatcaatgatttcctgtaaggctttatcaatatcgtcacttaacgtttgttcatttttgttaaacataaaatacactttggcatttgaaagcacatgaccgacggttttttctttaatagcgctcgtcttgttttgaaagtctactgcaaaaggcgttgagatcgttgcgtccgcacgccccgatttcagctgattcgcagtctcatttgcgccttggccctcataggcaatctcaaacggccgtccattatcctcattccattttttcagtacaagcgctccgttggaggttgcactcgtaatcacccgttttccttttaagtcttcaattccacggatcgtatcgttattttgaagcacagtaatttttaaaggaaaatggttgtaagcaaccttgttaaacagaaattttttctcacgctctttgcttttctccatttgatgtgccacgatatcgactttatgctgtccgaggctgacaagcaggttggaaaattccatcgttttaaatgtgaatttataatgtggcaggcgcttatcaagctctttgatcagttcgacatcataaccggttaaatcgcctttttcatcaataaagcaaatattcggaaattgggttccagttccgaccgtgatcgtctgtaccttcttttgcccggctcccgtcgtttgactgcctgcaccgcaagctgacagaactgttataagcgaaaataatattgccatgaatgctgttttcgttttcatctcatcgccccatttatttttcaaaacttgattttgaataatctgccccgagccattttcggcttagtttttttagcgttccgtttttctccagctttttaatcgcttgatccgtgtcatccgccaaggtttggctgcctttattaaacataaagtacacctcggtatctaataacacgtcaccgactgtcttttggcggaaggcgtgcgttttattctgaaaatcgacggcaatcggtgtagctatcgttgcatctgcgcgcccggtttcaatttgattggcggtatcattgcttccctgtcccgcatatttcaaatgaattgggctgccgtgcgttttgttgtactttgtaatataatctgccgcatttgacgtggcgccaactatgactgtttttccgtgtaagtcttttaatgtatgaatcttgtgattatcctctttcaccgtgatgtacatcggcgagtagttatatgggactttatgatacaaaaaacgcttttctcgttctttatttttggccatattgtgcgcaatcacatcaatttttttatttccgagactcgtcagcaaatttgagaaatccatcgttttaaattcaaatgtatattgaggcaactccttatcgatggctttcatcacttcaatgtcatacccggtcaattcacctttttcatttaaaaacgcaatattcggaaaatctgttccagtgccgactatgaccgtttgagcctgacgatctgttttgttatttgtttgcgaacatcccccgccaagtaatgcaaacactgacagcagcaaaaccaatcctttacgcttattcataggctgcctcacatcatgcccagctgggcgcacctaaaagcgttgggttaaatcgttccggaatcagaaccttgtgcatcatcacacctatgtccccgtctttttcctgctcaaaatacacttcataccctctccttctgtacatgtcagcaagccaaggatgcttgcgcgccgatgtgccgagtgtcagcgcaggagccttcagcatatctcgaagcactttttcttcaacatacgtaagcagcttacttccggcgccttgccctttatattccggcagtgtcgcaaaccaccacacaaatggatattttgaaggaggcgtctcactctcccacgggaacctgattgtaatcgttgaaatcagcttcccatcccgctccagcacaatcgctgaatgatgttcaatattttctgataccatttggatatcagctctcgtggatggccaatcaatatccagctgccgaatgggctgaaatgcgctgttaaccagtttcaacagctccgatgcatcttcaacagttgccagtcgaaaaatatcatcactcatttttgtcactcctcttcacaatatatataattcctatttgtttactaatcttttattgtttatactataaagcatactctgatctttgactaatcaaaaaaagtaaaccttcacttcagtaattttaatgatgaaaaacaggagggagaacattggagttacgctcaatcaaaacgtttcatacgattgtaaaatttggaagcttctataaagctgcagaaatactcaactactcgcagccgacgatatcgatgcgtatgaagcaattggagcaggatttaggcgtactgctgtttgaaagaggaaaaagcctgcagctgacaaaagcagggaaacttttttatgaacgaacaggagatcttttgatgcaatacgaggcgcttaaacacaacctctccgacttaaaggaagaagaggcaggcattatcaacataggggtttcagagccaaccgccagtctgatattccccgagattttaaaggatttcttaaaggattacccaaagataacagttaatatcaaggttgatgacgccaatacctgcagtcaaaagctcttagacgggacgattgattttgcagtctgcggcgagccggagctgattcttgaaaattactaccatccatttttttatgacacattaaatgtgattgtatctgagcaacatccgctcgctgagaagaaggctgtccatttgtctgatttagcagaagagcgcttcatatttacgcccgccaattgccccattcgcttacaaattgaacagcatttacatagagaactcgggaatcgttacaaaaaaatggagctcacaagcagcatgtcacatgaatattacgtacgtgaaaacatcggaatttcaatctttaccagcaccgcacattctaaaccgttcaacggcactaaagtcattccaattctgaacctggatatcaccccgcccatagggctgttgacaaatcaaaaagaagttcattttgaccgcgccacgaaggacttgatcgcccggataaccaaacgttttcagcagcgcagcaaagaattggaaggaacctctgataagaccattacaggataactgaaaaaataaaaaccacctcctgattcatcaggagatggtttcacggtttaaagctcgatcgtctcaccgaccgacatgactttgccgactccgcccggcaggctgtcagcgaatgcttctgggtcttgttcgatgaccgggaatgtattgtaatgcaccggcacgacctgttttgcgcgcagccattcagcagcaagcttggcgtcttcaggccccattgtaaagttatcgccaatcggaaggaaagcaaggtcgatatgattcaattcgccaatgagtttcatatcagagaaaagtgccgtatcgcccgcgtggaaaatcgttttatcttctacagtcagcaaaataccggcaggcatgcctgtgtaagtgatcgttttgttttcttcatctgtgatggctgatccatgaaaggcctgtgtgagcttcacttttccaaaatcgaactggcgggagccgccaatatgcattggatgaacattcaagcctttccagcctaagtacacagcgagctcgttcggggctataaccaacgcgttattttgcttggcgatttgttcagtatcaccgacatggtcattgtggccgtgcgttaataagatgacatccgcttttacatcctccggctttatatccgttaatgaattccctgttaaaaacggatcaaaaataatatgatggtccttcgtttccactgtgattacagaatgtccgtgatatgtcactttcatttctttcacctcgtcacatgattttgatttttttattttccctttttaaaaagctgaaaaacttatgttgtttgattcttgttaatgacattgaggccaccggtggcttcaatgacagtccctgtcacaaggtctgagttctcctcacacaagaaagcgataatccgggcgatatcctcgcctgtaccggatcttcctatcggcgttttttctttgccgattcgcattctggcttcctctatcgatgcttctttcatgtcgccgacaatgtctcccgggcaaaccatgttggcggttatgccgaattcggcttcttcaatggcaattgtcttcgtcaaagaagccaagcccactttcgcagcgccaaatgccgatcggtgaagccagccgggcgcgtgagccgcaccttggaatccgtacgtaatgatgcgtccaaattgctgttttctcataataggaataaccgctttgaataaatgaaagacggcgcttaaatttccttccagcatgccataccattcatcatcagtataatcggctaactttttacgttcaaatatgtatggtcccgcgttgttaatcaaaaagtcgatccttccgaagcggtttaaggcagcctctgcaatacgcagcagatcttcttttttggtgacatcaccttttacaaattgcagccggtcaagacaatcgggacaggcttccttcaggcggctgactgcctcctcatcctgtctgtaattgactgttactgaatacccctttgcaagcaacgtttcagtcactttgcggcctaaacccttcgaaccggcagtaattaaagcatgtcgcacatgaatacctcccaaagcaacgtcgccgctttcaataaagtgtttcttcttctactttactataaaaggcttgcaatatcactttttacactttggcatacaaaaaaagctgcctgtacagacagcttattctgcaggagatgaagactcctgatcaggcatatcgacataaccgctttgatatgcttctgaaatgagccttgttgtctcctggctttcttgttcatcataaatatagcgttccggttcttttttcatcattctgcctcccatcattatagaggtaggttggctataatgacgggattttatgaaggaaattttaacaaactcctgctgctacgcaagctttcgctttttcaagcgcctgctttacctgtttgaatccggtgcccccggcgctcattcttttttcaactgcgtagtaagggtctaacacagtgtaaatatcttcttcgaatagtgtgctcgcctgctgaaactcgccaaacggcatatcgcttaaatagatccctctttcgatgcatgtgtacacaagtttcccgaccacttcatgcgcttctctgaacggcattccctttttagctaaataatccgccagttccgtcgcatttgaaaagtcttgttttgttgcttgcttcatgacgtctttgtttacagtcattgtttggatcatgcctgtgaagatttgcaggctgccctccaccgttttcaccgtgtcaaacatgccctctttgtcttcctgcagatctttgttgtaagcgagcggaagtcctttcatgatcgtaaacagccccatcatatcaccgtatacgcgtcctgttttgccgcggatcagctccgccatatcagggtttttcttttgcggcatcatgctgcttcctgttgcgtacgtatcgtcaagctcgatgaatttaaactcctgcgagcaccataaaatgatttcttcagagaaacgggataggtgcatcatcagcatactgctgttgcttaaaaactccaaaatgaagtctctgtcgctgacgccgtccaagctgttttcataaatggcatcaaagccgagcagttccgctgaataatcacggtcaattgggaaggttgttcccgcgagcgccccgcagccgagcggagatttgttaatccgcttcattgaatcctgaaaacgctccttgtcgcgctcaagcatccagaaatacgcaagcatatggtgagcgaatgaaatcggctgggcgcgctgcagatgtgtgtagcccggcagaatcgtttcaacgttcgcttccgccttttcaatcagcgcactttggaatgcctcaatcagctcgatgatgtggccgacatgattcttcaagtataaatgcatgtcagtcgccacctggtcattccggcttctgccggtatgcagcttgccgccaagaggaccgatttcgtcaatgagcattttctcaatgttcaaatgaatatcctcataatcgactgagaattccaatgctccctcctctgctttttgcaaaagggtattcaggccctctcggattttcaactcttcttctgctgtcagaataccgcattttttcagcatggcagcatgtgcgagagaccctgtaatgtcttcagcaactaaattttggtcaaatgatatggacgcgccgaactcgtcgacccatttttccggtgttttttgaaatcggcctccccagagcttcttcatgctttaatctgctccttcttttttacgatgctgttcacttttgtcggaagtccccaaagctcgataaatccaattgctgcatggtgatcaaatgcatcgtcttttgtatatgttgcaagtttttcatcatatagagagtattctgatttacgtccttctacaattgcatggcctttaaacagcttcacgcggacaatgcctgtgacatgcttttgcgtttcttttaagaaagcgtgcagcgcatcttttaacggcgagaaccataagccgttgtaaatgatctctgacattttttgctcgatgatcggtttaaagtgggctacctctttcaccagtgtcaaatcttctaattctttatgcgctttgatcagtgtcatcgcaccagggcattcgtatacttcccgggatttaatgccgacgaggcggttttccacgtggtcgatacgtccgacaccgtgcgcgcccgccatttcattcagcttcaagatcagctcagaaagcgagtaggaaacaccgtcaatggagacaggcacgccctgttcaaatgcaatttcaatcacttccggcgtgtccggcgttttttccagcggagctgttaaatcgtatgcaccttctggcggcgccgcccatggatcttctaaaatgccgcactcattggcgcgtccccagaggttttgatcgatagaatacgggctgtcaagattgatcggaatcggaatgccgcggctagccgcatattcaatttcttcttcacgtgaccactgccattcgcgaaccggcgcgatgacttctaggtcagggtttaatgatttaatggagacttcgaaacgaacctggtcatttcctttcccagtgcatccatgggcaatcgcctgtgcatcttctttttccgctatttcaaccagctttttcgcgatcagcggccgagataatgccgaaacgagcgggtattttccttcatacatcgtgtgggcctgcaaagaaataagcgcgtaatcctgtgcaaattcttcttttgcatcgatcacgtaggagtttgtcgcgccgacttcaagcgctttctgctgaacaaatgccaaatctttgccctcaccgacatccaggcagcaggcgatgacattatatccttgctcctgaagccattttattgcgacggaagtatcaagaccccctgagtatgctaatacgacttttttctgttctgacatgataaaaatcccctctcaaccgtgtttctattttgtataaaaataaattatatttaataaaaatacattttgtatgtatacactttaacaagtacgtttcgttttttcaagccttttacaaaaaaaacttcacctaaatttcaggtgaagtttcgtagtatttattcatttacttgtcttttctgatttctctgaccacatgtgcaagttcgggaataatcagcttattcattgccagctttaccgcgccgcttgagcctggcgttgagaaaacagcggtatgctgaatgacgccggcagttgctctcgacatgattgcggcagggccgatatcctctgtataactcagcatcctgaatatttctccaaagccgggcagttctttcgaaaacagcggcgttatggcttcaattgtgacatcccgatctgctatgcctgtccctccgtttaagagtaccgcgtctgtctgttcatccatgcagcccgcaagcactgaccgctgcaaagcatccttttcgtcttttacaatttcatatgcggcaatatgatgaccggcttcttctaaaaatgagatcatcagcttgccgcttttatcggtttcatctgtcctcgtgtcactgacagtaatcactttgcaccgaacgatatcgggagcttcttgtttatgctcttgaacgctcattggcccacctcttttatgttttctgtctgtcactatcatgcatcaacaaaaaagcacattcaagagaatgtgctttcatgcgatttattttgctaaacgaacaacgtcgcgcgcaatcatgacttcttcatcagtcggaatgatcatgacttttactggagaatgcggatagctgatgaaagcttcctcgccgcgcacgttattaagcgcaggatcccagtatacgcccatgaattctaaaccgcgaagaacgcgttctctgacttccacactgttttcaccgataccggcagtaaagatgatcgcatcgacaccgctcattcttgcagcgtaagaaccgatgtatttgtggattctgcttgcgaatacttcaagagccgtttccgcgcgctcatttccttctttcgttgcttcaacgatgtcacgaagatcgcttgagaaaccggaaatgccgagcagtccgctttttttgtttaatgtattcagtacttcgtcagccgtttggcctgttttctccatgatgtatgggatcagggcagggtcgatgtttccagagcgtgtgcccattgctacaccggcaagcggcgtaaagcccatggatgtgtcaatagattttccgccttcaacagcggcaatacttgctccgtttccaaggtggcaggaaatcaggcgcaagtcttttaacggacggccgagaagctctgccgcacgctcagttacatatttatgtgaagtgccgtggaagccgtatttacggatgccgaatttttcatagtattcatacggcaggctgtaaaggtaagactgctcaggcattgtttggtggaatgccgtatcaaatacagctaccgcaggaacatttggaagcacttctttgaacgctttaattccaacgatatttgccggattgtgaagcggtgccaattcagaaatatcttcgatttccttaatggtttcatccgttaataaaacagaatcgctgaatttttctccgccgtgaacgacacgatggccaattccgtcaatttcattcaagtctttaataatgccgaattccgttaacttattcagcagcattttaacagctaccgcatgatccggaatatcagttacttctgtatttttttcgccgttcacagaagttgtgaatacgctgtcggcgataccgattcgttcaactaaacccttcgttaaaacggtttctgaaggcatttcgaaaagctgaaatttcaaagacgagcttcctgcgttaattgcaataattttggacatgattgacgctcctttatactctgtatcaacaacttcgtttttcgtacttttttcccggtgaatatcaacatcttctccgaaaaatatctgacttttccatttaaacattgtcatgtcggcttttcaagtcaacttgcgtattgataacgcttacaataagaagtcgttattttcagacacattccctataggttttgtattgatgaacgcttacaatttgcggtttttccctctgtattttgtgtttcaaagctggattcaattcgtcaagtccggtcttcaaaagcataaataaaagcagcttaggcatcgacctcatacggctgtctaagctgcttttaaaacacttacttttcttttttaaaccattcatcaaattgagccatcatatcaagcatcgccttttgattggagaaagacggaagattcgcaagcagaatttgccccggcgctttcgtattctctccttgtttctgaagcacaaggatgcttttggcatgagcttcgtctttaaaaatagattttggcagctgcaacagtgcgttgatatgaaccttatctttgaaaaactgtttcagcttgccgctttgggagctctcaaacaaatgattcggaatcataaaaaataagtagccgcccggtttggtatgcttgacgctctgttcaataaacagatgatgagcgaaggaatggccttcgtcagctttaagctcaaacgcttctgctccttcgtcattcggataatagccgactggcagatcacaaatgaccgtgtcaactggatcgataaacaacggctcaaggctgtcctggtggaaaagctcaagctcttttttcagaaggttcgcttgggcataggcgatcttcaagagcacatcatcaatttcaatgccaaagctgtttgccgttttttcagacagctggttcagcacggtaaacagaaggttcccagttcccaaggctggatcaagaatggtcaattcctttttgtccgccataaacttattcaccaaatagctgatgaaaagcccgatcgtatccggcgtcatttgcctgtttggatgggagatatctttcattcctttaaggacggcaagctgaaaagccttgcgtacccactcatgctcatacgtgccgaattccgctttttcaagcagagcctgaagttgtttggttttctgatcagcaggcagtttcagctgatccgttttttcaagaaaatacatttctcctgcttcggcaagcgcctctatatatgaaatctgcaattcattctttatcataatcgctgcttcgtttaacagctcatacaccgcacctacatggtctttttgcatattgtgttcctccttgccatgaaaaaagctccggcggcagcctggagcttttttccctgcttacttcactaatgccttagcagcctcaattggcttttcatagttcgggtggtttgttgcttcgcttacatattcagcgtaaacgacttttccattctcatcaaggacaaatacggaacgcgcaagcagacgaagttctttaatatacacaccgaacgctttgccaaatgacatatctctgtggtcagacagtgtttccactttgtcaattccgttagcgccgcaccagcgcgcttgcgcgaatggaaggtctgcactgattgtgtagacgttgacatctccaagctttgcagcttcttcgttaaaacgtcgtgtttgtgcatcacaaacacctgtatcaattgaagggataacagaaataatcgttacctttcctttcatgtcagctaacgatttttcttcaaggctgttagtcagcactgtgaaatcaggagcttgatctcctaccttcacttcttgtccgacaagtgtaaccggaccgcctttgaatgtaatttcagccattataattcctcccttttgtatgtatgtctctatcatagtaaagtttcctgcaaactgcaaagtttatgccaaaaaaaagttaactgcggccagcgcagttaacctttttttaataattcatattgttcatttggttttgattttggccctgactttggttcttgttatttttcttgaacatttgctggatgcgttcgagtgtttgaggggctgcgtctaaaattttctctattaaatgggtattttcatctaaatgaagcattctgatgcctgtcgatccgacaattaaaaacgcgatcggcgtaatggacacaccgcccccgcttccgcctccgaaaggaagtttctgttctcttgtctcatcgtcttccgatttcttttcggccggctttccgccaaactcgcttccgcctgcggcgaatccaaatccaactttagaaacagttaaaatcacacttccatcaggcgtttctactggatctccgatgatggtgttaacatcaatcatttccttcaagttttccattgcggttttcattaatccttggatgggatggtctgccatatacgcttcctccttaaactgatgaatcattctttgaagtcattctagccgacggattcttctttaatacggatagctcccgtccgtatttgacgaatttgaaagctgcaagcatagcatgtccaaagcgaaaaaagaatatacactgaaaatgggtcttggaagcaggggcttgaaacgacgggatcacctcatagacaggtttattcacaaagtccaggtggtcgtagagcattgctgcgataccgcccttcacgccccatacagcacctgttaacacacctgtcactgccgcgtcctgaattccgattactgtaacccattctagttttgtgatatgtaaatgcgcgagaaaagacgcgctgattttccgtagtctggtgacctgatgcaaaagcatttcgattttattaatgctttgctgcacatcgttttgtgtaatttttttctttccgctgctttttttcattttagattcagttttttgtttgatatccactgttccgtcttctttgttcaccttaatcgccgggattgtttttttgatccttataaggccaaacagcgccgtaatcttcaaggtcaatttgtcattatcagcggcatgaagatactccagcgcgacatggattttcattctgagaagcagtacgatccctatgagaataagaatggctgtcagtacatacaccatattcttcacttcctctaggagcattatcgccaattcctaaaaaaataaacccggacggaggtccgggttatcggttatttgcggtataatttttcatgcaccacggtggtatccgcgatgtaatcatgaatcccttgttttgtaggtgaaaaagcaacaacgatatataaaatccaaatcttatcaatataccgtccaaccacttcacgaaaaatcactgtactccatgtcagcttgctatcttgcttcacagaaaccactttgaggccgaacaccattttaccaagcgtctgcctgaagtatttagtcattagtgcgaagtaggcaagatacacaataagcgttgtcacactgtaggccgagaaggtaaacatgccggatgttttcggcagatccaatacggtaaagaggggagaaacgagcaaatggtttaatccccatatcacgagccaatcaagcaggaaagcccagaaacgaacccaaaagccagcataggcatgtgtcagctgctccgcttcttgcgggcctttgatgtcattgcgctctaactcttcatatgtcgcgtccattattgttccctcctacttcgcatagagatacatcattctcggcgaaccggattgcgatagaatttctctcatattcaaaaaatcaatttcacttttaaacattttgttcgcgcccatggaaaacagtgagcctaatccgaagctttcctcataagaaatgacagaggcgtttttcaaatccttgtgatcctttttcatggccgtaatggtatcgtcataaaaaccaagctcatcaacgaggttcagttttttcgcctgccgtccgtcatacacgcggccgtccgcaattttctttacctctgctttcgacatgccgcgcccttttgaaatgacatcaacaaagccttcatacgaattatcaaccatcgattgcatgatgtttttttcttctttcgtcatctcacgggaaggagacataatgtccttatgggccccgctcttaatcgtttcataagaaatgccaagcttatcggcaagctttgaataattgacgctttccataatgacgccgagtgacccggtcagggtttccggtgtcgcaaaaaccttatcagccgctgttgagatgtaatagcctcctgatgctgccatcgaacccattgacacgtaaatcggttttttcgtttctttcttgatttcttccagtttcttatgtatttcagcactttcatacactccgccacccggagaattcaccttcagaacgatacctttgaccgtcttgtcatcttttgcgcgctcaaggttttttaagaacgttctgtggttatatccgtctgcaccaagcagactgcttgagtccccattatcctgaatggtgccgctgacctctaatacggcaattttacttgagagactgccgttttccagcgtcttttcctgcgattcatccgtcagtgatgtgagatccgtttgagcgcctttgacgctttcaaagaaactcatagagatgctgacgataatagacacgccgaaaatccccagagcaatcactaatgcaatccatctttttgcattcattttttctcctcctttttcctaaactctctcattatacgattcaatatgaaaaatgtttcacttcatgagaaagctccggcttaacgggctgccggcaaacgtggtacacttatggccaaaggtattttatcacaaatactggatggcagaaaaacttaaatatgacagcaaaggggaaatgggatatgaccgatcaacgccgtaatgtttatttttttcacaaacaggatcaggaaacgaacgaacaagcccgctcgttaacacaattagcggaagagcatggatttaccgttgtgaaccagcactcagacgccaatattatcgctagcattggcggggacggcacatttttgcaggcagtcagaaagacgaattttcgtgacgactgcttgtacgtcggcattaccaaaaaggggaaagctcatttatattgcgactttcatagtgatgagcgagaaaaaatggtcgatgcaatgacgtttgaacaaattgaagtgagaaaatacccgctgattgaagtgacagtggatcaagccagtccttttcactgcttaaacgaggtatccatccgctcaagcatcatcaaaacctttgtgatggacgtgctgattgacgatctgcactttgaaacgtttagaggtgacggaatgattatctcaacgcctacagggagcaccgcctataacaagtctgttgcaggagctgttgttgatccattgcttccatgcatgcaggtatcagagcttgcatcccttaacaataatacctaccggacactcggctcgccatttgtcctcagctctgaccgaaagctgacccttcgtgtggtgcaggacggcaacgaacacccaatcatcggcttggacaatgaagcactcagcacgagaaatgtgaaaacgatcgaaatcaaactgtctaataagaaaatcaaaacagtcaaactaaaggacaattcattttgggaaaaagtgaagcgtacttttttatagaaaataaaaggacaggctgctgcctgtccttttatgatttctcatatacaatctggccgttaatcacggtttttttaatatctaaaagatgaagctgtgcggggtcaatggcaaacggatcaccactgagaactgtaaaatccgcatcatagccttccgcaatttttccgcgtgacttctctttataaatgataccggcgctaccttctgtataaagctttatcgcttcatatacaggtaaacattcactttcattatagcttggcccgttttgctcatgactgcttttcctgaggaccgcggactggatccctagaagcgggtcaacaggctcaatcggggcgtctgaaccgcccgcgcataaaatgcctttagatatgagggttttccaggcaaatgcagtcttcatccggtcttttccgagacggtcaatgacccacggaaagtcgcttgcaacgaaatgcggctgaagatcaagtgcgatcggcatgcgtgctgctctctcgattaattcgttatcaagcacttgggcatgaataagccgatcatgccggccgtttttgggcggatgcttttcaattgcgttcagcactttttcaaaagcaagatctccgattgcatgaactgcaacctccatccctttttctctcgctttgcgaatgagccggccaagggtttcatcatcgtgaacctgaacaccatttgttgatggatcatcctgatatggttctttcaataaagccgttctcccgccaagcgccccgtccgcaaagattttcatcgcaccgaactccacatacgggccggacagcttctccagctgctcccatcgatcgaccgcttcatgatgaacgagcaaatggcagcgaaacggatactttccgccagcggcagctttctcataagctttcaacggcaccgaaacatcaccataataggacaagtcttccgaatgaccgcccgtcaggccttttgtccagcaatcctttattgcagccgttaatgcctcatcaacatagtgctgagagactggcgggacagccttcagaatcaaatcctgcgccttatcaaacaggagtccggacggctctccatttgcatcttttacgatgactccgccgtcagggtcaggagtatttcttgaaattcccgctgcttgaagagccgcagaattgacagctattgcatgccggcatatacgcttgagcaagacgggtctgtctggaaacaggcgatcaagatcatgcttagtcaagtagtcaggtgtcccaaactgattttcattccagccctctccaatgagccaatcgtttttaggaagctgccgctctctttccttcgcagcctgtaaaattgaatctttcgacgtcagtgcggacagatcgagctgaagctgtttctcaccgtggccgatcaaatgtaggtggctgtcaacaaaaccggggaacatcactgcaccgttcaggctgatttcttctgtttccggtgacccgtacttttccttcaaacgttcatagctgccggtgccttttatgacaccatcctcaacataaactgcctcagtccgatcgccttcttcgagcatcgtataaatgaaaccgccgtgccatatcgccttcattcacgttcactctctttctttacgcctttttattggctttgagctgttcttcacgttttcttaattccactcgtctgatttttgcagaagccgttttcggcaggctttccacaaattcaatttctctaggatatttgtatggagcggtaatcgtcttcacatggttttgcagcattttgacaagctcatcactgcgtttttcatgattttgcaggacaacatatgcctttacgatggagcctctgatttcatcagggcttgcgacaacagcacattcttttacttctgggtgcttaacaagcgcgtcttccacctcgaaaggcccgatcgtatagccggagctgataataatatcgtcatttcggctttcaaaccagaagtaaccttcctcatcttttcttgctctgtctcccgttaggaaataatcgccgcgaatttgtgttttcattctttccggatctttaaaatactctttaaagagcgcaggcgtactgaggtgaacagcgatatcgccaacctcaccaggtttgcagatttcaccgtcttcatttatgatctccacctgatttcccggtgtcggttttcccatgcttcccggtttaataggcgtatctttcaaaacaccaaccaaaagcgtgctttctgtttggccatatccgtcccgtaccttaatgccaaagtgcttttggaaaacatcaatgacttcacggttgagcggctcacctgcggaaacagcgctgtgcagggcagaaagatcaaagcgttccaagccttcaaccttcgccattaagcggtattctgtcggagtgcagcagaaaacattgattttgtagcgatttaaaagctctagatatttttctgctttgaatctgccgtggtacacaaaaccggttgctccgctgccaagcaccgctaaaaacggactccatacccacttttgccagccaggggcagcagttgcccagacgatatccttttcagaaatgtcaagccaagcgccggcagaagtttttaaatgagcaaatgcccatccatgtgtatgtacaacacctttcggctgacctgttgtcccggatgtataagataagaaagccatatcatctcttgttgtgtcagctgttttaaattggcttccgtccgcttcaattgataagaggtttttccagccggcatcattttcaccaatagacagtgtaatcagtttgtcagtcgtactgacatcccggaaagcgccaataaattcggagtagacgatagcgccttttacctctgcatgttcaatccggtattcaagatctttcgcgcgaagcatttcggagcacggaatgacaaccattcctgatttcaggatagccaaataaacagcataggcttcaagcacccgcggaaccattacaatcagcttgtctccctttttaaatccaagatcagctaaggccgctccgattttatttgtttcttccatcagcttttcatacgaccaagattcttgcttgcccgactcgtcctcccaaagaagagcggttttttgtccagcggcactgaacttttccatttcattcactaaattatattgcataggggcaattaaatcttcacgttttaacacgaacaactcctcactttctccacccattatacataaatacaggctctttccgtaaggatatgcctaaaagcaacctctgtaaacatagattttataggccgctggtccttttttatattataaaaaatgaaaaggagtggggatacccccactcctaagccattatgtgaaattgtaaattagaattgtcctccgcccatgttttgttgagcaaaagatacaagacgttttgtgatctctcctccaacagaaccgttagcgcgagaagttgtgtctgctccaaggtttacaccgaattcagaagcgatttctaatttcatttggtcgatcgcttgagcagctcctggtactaaaaggttgttgctgttacctgagttattgttagccatgtgtctcacctccttgtgagtatagaatgtgtcaaaacacatggcttcattcagaaaaactttggtaattgtatacaggagctgaaaattgatttaaaagagttcagcgaatttatcgttagcttcttgttcgctataaagggtcattgtctcaatgttatctaccgcttcttgaatatacggctcgaaatcaacaaagctttcaaagtgttcaattttctcttttttagggcgtgttttcgggcttggcggtgtaaagatcgtgcagcagtcttcaaatggctgaatgcttgtctcatatgtgccaatttcccgtgatttttcgatgatttctgttttgtccatggcgattagcggacgcaaaatcggtgttgacgtcaccgcattaattgcatacatgctttcaagcgtttggctcgctacctgaccgaggctttctcccgtaataatggcaagcccgtttctcttttctctgattctgtcggctatctgaagcatgaggcggcgggttgccgtcattgtgtaattttcaggaatttgtttttggatgagctcttgcgtttttgtaaatggaacaatatgaagtgtcatgcttcccccaaaacgggacagacatttcgccagatccattaccttttgctttgcgcgctcgcttgtgtatggcgggctgaagaaatgaacagcttctaccgacaatccccgtttcatcgcataaaaaccggccacagggctgtcaaaaccgccagaaagcatcagcatcgcttttcctgctgaaccaactggcagcccgcctgcacctttttcatcacgaattgtcaaaaatgttgcttcttccctgatttcgattctgagcgggatgtctgggttgcgaacatcgaccgtcaatccttctgtatttcgcaaaatatggccgccgatttcagcgttcatctggtttgtatctaattcaaattgcttatacgctctctttgtcgcgactttaaacgtatcacctggtttatactgatctttgatagcctttagtgcggttgccttaatatcatcaaggcggctgtcacatttaattgccaggctgaagctttgaatcccaaacacttgctttaaatgaggaaaaagagcctcaggatcctctccatttaatgtaatcgtcatacgatccctgttggaaaagtattttaaattcggatagtctttcaaaacgagtctgatgttttgttttaagcgctcaataaagctttttctgtttttgcctttggtcgaaatttccccaaaacgaattaatatatgatcgtaattcatgttctacctcatcattttccttaattttttgataccaggacgaagcgcgttcataaacggttctgccacatcgcttgtctggctgtaatttaaactgattctgatgctgcttccggcaatctgctctcctttgcccatctctaagagaaccttgctgggcttatgttcttttgccgagcaagccgatgttgtggagacgaaaatatcctgttcctcaagcatgtgtaaaagcacttccgctttaatccccggtacagagaaattaataatgtgcggcgcgctattcatttgaggcgtgttgataacgacgccctcaatttcactcagccttttcataaacaattcctttgcggcagtcatcgtgtcaagccgtgtgtcaaaatcagcagaggcaagattaatggccttggcaagcgaaaccgctccagcagtatgttctgttccggcccgtatgcctttttgctgagagcctcccgttatgagcggaataaggcgtgttccctcttttacaataagtgcgcctgtcccctttaggccgtgaaatttatgccccgaaattgaacatagatcaatgccggccttttcaattgccaagggcactttatagatgccctgcacataatcgacgtggaacaaaatgttcgggtgcttcttcagcacttcccctgccgcttcaatcggctgcacggaaccgacttcattgttcacatgcatcatgctgacaagcacggtatcgggacggatggctgcttttagatcttcaatagaaacaaatccgtcttcattcacagaaagataagtgatatcaaacccgaacaactctttcagctgttctaacgattccgtaacagatggatgttcaatagaagtggcaatgatatgtttgcctgtttttatctttgacaaagccgctccttttaaagccgcattattggcttctgtggcgcctgacgtaaatacaatatcatatttttttaggcctaaggaccttttgatttgatttttggctgcttgaagcagctgttccgtttcggctccatatcggtgcaaagatgaaggattgccaaagtatcggctgcttgtctgttcatatacgttcaagacttcatcgtaaggcttcgtcgttgaactattatctaaatatatcatcttttttactcctttatgaaagcggtacaaggtatgatatttatgttaccataacaaaatttaatagaaaattacgaaaaactagtattgacttctaatttttttaccatataataagatttgttcgtttcgtcatattatctgacaattaattgacagaatattttaacataattattaggaggatttttttcatgaaacactcactgcctgtcaaagataccattattattggtttcatgctatttgcgttattctttggagcaggaaatatgatttatccgccggaacttggacaagcagccggacacaacgtctggaaggccatcggcggatttttactgacaggggtaggcctgccgcttctcggcattatcgccatcgcattaaccggtaaggacgctaaaggccttgctgacaaagcgcaccctgttttcggcacaatctttactgtcgtgctttatttatcaatcggaccattattcgccatcccgagaacaggaactgtttcatatgaaattggcgctgttccgtttttgactggcgtaccagaaagactttctttattaatatttacacttatctttttcggcgttacgtactatttagcgttaaacccatccaaggttgtcgatcgagtcggaaaaattctgactcccatcaaattcacgattattttaatcattgttctcaaagccatcttcacgccgatgggcggattgggcgccgtgacagaagcatataaaggaacaccggtttttaaaggatttttagaaggctataaaacaatggacgcacttgcttcaattgtatttggcgttgtcgttgtaaatgctgtaaaaagcaaaggcgttacacagtctaaagctcttgctgcagcctgcattaaagcaggtgtgattgccgctttaggcctgactttcatttatgtatcccttgcttatttaggtgcaacaagcacaaatgccatcggtcctgttggtgaaggagctaaaattttatctgcatcttcccattatttattcggttcattgggcaacatcgtactcggagcagcgattacagtcgcatgtttaacaacaagcatcggccttgtcacatcttgcggccaatatttttcaaaacttattccggcattatcatataaaattgtcgttacgattgtcacgttattcagcttgatcattgcgaattttggactcgcgcaaattatcgcgttttctgttcctattttatcagctatctatccgcttgccattgtcattatcgttctttccttcatcgataagatctttaaagaaagacgcgaagtgtacatcgcatgcttgatcggtacaggacttttcagtattttagacggtatcaaagcagccggtttctcacttggatctttagatgtgtttctaaatgcgaatcttcctctttacagcctcggcatcggctgggtgcttccaggaatcgtcggagcggttatcggctatgtgctgaccttattcatcggaccatccaaacagcttaatgaaataagttaatgtcacagaacgcctgcgttattgcgcaggcgttttgtaataagaaaaagagcctgctcattacactgcgggctctttttcatggtcgtgattatctaagcggatatgtcagctttgattttttcaactgcacctggcgcagccttttctacagcggtagctgcaatttcataagagtcgtcataatcaaaagcataaaaacgtctttccgcttctttcagctgttcagataaaatatgattctggcttctgaaccggtttccgaactgaatgattttttcaatgaggatgacctgctcgacaagttcctctgattcccggcttgccctgttgacgatatcttctgcttgtttcaaatgggctccggcttcttccatatttaatggaagttcgtttagttgattgaccgtttcttgaatatgatgatgcgcgttctccagcatctcttgaatatggctcggaatgcctggaatgttgctagtcttcagcagtcttgctgtctcagaaattgtttttttcaaattgctgagcgtctccctcgcctgaagctcttcttttctcagcgcttgcagattttcacgatactcgtcatgctcttttttcacttcttcaatttgcttctctattgaagcaacttcttccactaaaagtgagtaggcaacatgctctgcatcgagcttatctttaacggatgatagcagcttcccaatttcatcaaggcgcttttcaaaagcctgctgtttgccgagctcaccggctgtcagcctgtagctttccttcaccagctcagtttccgccttcgtatgctctttctcttctttaagcttgtcgtaagcaataatcaattcaggcattttgcttagtacggattgaccggcttcaacttcgccctccagctgctgataaacagattgaatattttcgtcaatgagctgcaggattgcggacgcttcatcaatatccagctcagtcatcaggacatgttccgctcgtttcagctggtttgacagattttctaattccttatcaagctggatatgctcaagcttgtaccctttttctttcatttcgccatagccatccttgagctttgcaatctgtccgggcaccgtctgtttacagtcagctaacagcttcggcacatcatctatgtatgactgaagccgttcaagattgcggtcctgctcaagcagtacttttcttgcagtaatatagtttccgccttctgtttcttcttcaaattgtttgatgccgctccaaatttcgtccagatccttttcaaggctgtcataaagctccccgtaaaggtggctgtaagccagcaggttttttcgagatttcgaatagcgctccctcacctgttcaatctcttcacggctcttttcctcacttgtgacaagatcgctgatttcccgaagaatcttttcaatgcttgattcagccgctgtcagcaggtcgtcgatatgaacgagcacttgattggcctttttaaaccggtatttgtctgcattttcctcggcatcataaaggagctcttcaactttcggcatgtgggctgtgacaatctcatcccattcttcacgccacttctcaaagaactcttctgtctgacccgtcatttttaaatgttttattttagacatttcttccacgatcgaccgatttagaatttcaatcttccacgattccagccggtcgatttcggcgtagacttttttcctgaaaaagtagcctgccgcaaacagcgcaagcagtacaattaataatccaatgacaaactccataatgagcccccttgctgtttaccttaatctgtcagggtgttttatttattcagaaagatttcaggatatgtattgagaaaaactgtcgttttcattgttattatgataccatgtaacaaacattttttgaccagaaatcaaaaactttttgtgcaaaatcggcaggatttgactattttttcatggggtgacatcaatgcaaaagcgagacggacatattcacacaccattttgccctcacggctccaatgacacactcagacaatatgcagaagaagccttaaaaaaagggttcgaatcgattacttttaccgaacacgccccattgccgccctcttttaccgatcccacgccgctgaaagacagcgcgatggcgcaagcttctttggaacgctatattcatgaaatttccggattaaaaaaagaatatcgcggacagcttagtatacggacagggcttgaagtcgattatatcgctgaatttgaagacgaaattacattattcctggacacatacgggccatatttagatgacagcatcttatccgttcattttttgcgcacagactcttcctatctatgccttgattatgacgagcataccttcaaagagctgatttcagcctgcggaagcattgaagcggtatatgaacaatattaccggagtatctattcttccattgtagcatctctcggcgtttataagccaaaaagagtcggtcacatcacactcgtccaaaaattcatcaagctgtttccatacagcatgtcagaacatattcgcggcctcgtttccctgtgcctgaatgccattgaagaaaacggaatggagctcgacttcaatacttccggcttaagaaaaacttacgctggcggtatttatatcgaggattggatgctgaatgaagcgaagcaaaagaagatcccgcttgtgtttgggtcagatgcccatcaagcgggagatgtcggatatgcgtatgaggcgtttttggaacggtgctagttggtgagcgccacgtctcctgtccggaagacgcttctgatccaaatcttgatttcttcaaaatacattttataaaaatacggctcgtgcggctgcatgtagagtacttctgaaatatattgaggctggagatagggcatcatcaagagagattttaattggagaataaaatgaggcagcggcagcgttaaatattcacgctgtttttctccttcctcaatgatcagctggaagatatacttttccttcattagatatgtcgacataatttccctgattaatgtggagtcaattgtgacttcccggtagacaaaacgagttaattgacgatgattatgctgataggataaaatatcgaaaaccaattgaagaagctgttcctgagtgctttgagaagagatattgcttgccgctgtttcaagcgttttgctgtagccctcgtaaaactctgaaactaagtgttccatcaagcctcctttgcctttaaaatagtaggagatgtgcgcaacatttacatcagctgactttgcgatttcacggacagacgtgccagaaaatcctttttggttaaaaagcatgacagcagattcaataattttgtctttggtgcttactttcatacggctcactccttcctcttgatactattcaagcagaaagccgctgttcctgtaagaacttatcgacaaatgccggcagaaaagccggaactttgttttatattatagaaaaagtgagggttttccatgttccatgtcgaaaaacaatctggagataaagaaaaaggctatcagcttctgctaaaacagctcgaagccatgaccgaagacgaaacagatcaaatagctaactatgcaaatgcctcagcactgctgtatcattcgctgcctgaagtcaactgggcgggtttctattttgccaaagaagaggatggacagcttttgttaggtccgttccaaggcctgccggcatgtgttcggattcctttcggcagaggggtttgcggcacagcgtacgcaaacggaaaagtggaacgtgttgaggatgtaaactcgtttccgggacatatcgcctgcgatgcagcgtctcaatcagaaattgtgcttccgattcgtgtagacggaaaaattgtcggcgtcttggacatcgacagcccagtgaaaaaccgtttcgacgaaattgatgaaaaatacttaactcaatttgccgaaacgctagaaaaagcgttagcgcagtaatataaaagcccaaaactgatatcgttttgggctttttttattttattgagtcatgaaccatcaagcggtttttcccgctccgtttcgcgctgtagagcgcttcatctgcctcatgcacaagctctttcagcgacttttttgtttctgtcgtccagcaggagataccgcaggaaatggttacctcgggtttcgtattttttctgaccgcgtaaaccagtcgctcggtaatccgtttccccactgcaaccggcacatttggcaaataaatcgccagctcctctcctccccagcgggcaccgacatcatgctttcggatgttgcttttaatcactgaagcgacttgaattaaaatctcgtccccagtctgatggccgtacgtatcatttacatttttaaaattatcaatatcaacaagaataaaaacacccttttgatggattttcatgctgtattgaattttttcatctaaatacgctcgtgaatacagttcagtcagctgatctgttttcacgagatgctcaaggcggtcgcgaagcattgaattggttacagccagtgtcgcgtgatgaatcagcgcctgaaacagcttgtacatttcaaatgtaaaagcgtacagctcctgtttcaataaaaccgcaaagcctaaaagccggtcgttttgaatcatcggagcagccatcagcgagccgtaccccgccttcccaaaaacagactggccattcccgatgaaaacccctttttcaccttcatacagcttttctttcagctcattataaaaatctgacggcttcgcttctttaaaaaatgctgtgctgcctgggagcaatgttaggttttcaaaatggtctatatgaaaaaatcccacttcttctgcctgaaacgattctgccattctcacagccagatcattcattgtatcagtcaatgtcagccgctgattcaggcgtcgtgatgtttcattaatcaattccaaatttgcgatgcttgctttggattgttcgtagagctgggcattttcaaacgcttttcccgcggcgtttgctaacagcgacatttcatcaaggcaggcatcagtaagaaagctgtcacccgttccttcagccttcaacaccccgtatgtgccctgctgtcctttgatcggaatataggcgacagattcatttttccgcaaaatgtctccggacaaatacactttgagcgcaaaggaatcggatttttccccttccatatatagctcttttgcaggaatccctaaacattggtcttgatcgtgcgatataaataaagaaaactcaaaaagagaaaatgtgcttgtcaagctttctaaaagctgcttcagcacatctgtctgatcaagcagtgaatggaacagctctgtcattttgtatatctttttttggtagatcgttttgttatagagtctttcctgtttcatcgactggtttaaaaatgaagcaaccacgtccggaagcccttcaggaatctcttcatcctgcctgcatgcaagatggaaacgcctgccggagccgtcctcaatcagataacatgaagcgtttatttttgaagcggaaaaacgcgcttcaccatctgccagttttgtcacaaagtctgatggtgacggtgtaagcgaaacacacagggttgaaaaataggtttgaatagccgaagtcagccatatgaaagagtcggtgaatgtgactttttcagatttggttaataaaaaatcgagcatatgataatgaaaggcggataattgatctttagtttgttctaccatgtttttatcacctaaaagtttaccactaatttttgtttattatatcataaacggtaaagcaataatggaggaatggttgacttcaaaacaaataaattatataatgacctttgtgtgaaatattgcagcctttttgttcagcttctatgttttcattttgttccttatcaataaggtgtatcgtgtaactctctgctgctggagcgaggatacatgaaaacaaaatgtgcatggtcgaatagagcagacggtttttattttccacaaaaataaaaccaaaggaggagtcacattatggctcgctatacaggtccatcttggaaactgtcccgccgtctaggaatctctcttagcggtacaggaaaagaattagaaaaacgcccttacgctccaggtccacacggcccaggacaacgtaaaaaattatcagaatacggtttgcaattgcaagaaaagcaaaagcttcgtcacatgtacggtgtaaacgaacgtcaattccgcactttgtttgacaaagctggcaaactagctggtaaacacggtgaaaacttcatgattcttttagattctcgtcttgataacgttgtgtacaagctaggtttagcacgtactcgccgtcaagctcgccaattggttaaccacggtcacattcttgtagacggaagccgcgttgacatcccgtcttacctagtgaaacctggtcaaacaatcggtgttcgcgaaaaatcaagaaacctttctatcatcaaagaatctgttgaagtgaacaacttcgttcctgaataccttactttcgacgctgaaaagcttgaaggtactttcactcgtcttcctgagcgttctgaacttgctccggaaattaacgaagcgcttatcgttgagttctactctcgttaatcgttttaaaaacccctgccgctatgcggtcggggtttttttatcgtctgtttcgtcattcgcctcttgctggccaacactttcttgcgcctgctgctcccaatgatcccgctgcagccgttcttttgcaatcgtacacatgagattcacgctttagcgctcctttcatttaaaaggtggtgattggtcgtgtttgccctatctaatatactcttttcctttcattcctatgcggtaaacaaaaagatcctttgccttcagtggcaaaggatctttttcttatttatacgtcacaaggaagtattttttcttcccgcggcgcagaacagtaaattgatcttcgatgcggtcttcacctgatagggtataatttatttccgtctggcgttcaccgttaatgtaaacagctccgttttgaatgtcttcacgcgcttggcgtttagaaggagataatttagattgcaccaacacatctacaagtgaaagctcttgggtgctgtcaacttccatagaaggaacatctttaaagcctacttttacgtcttgagcagaaagctctttaatattgccgctgaacagcgcttgggagatgttgatggcttgctctagcgcctcgcgtccgtgaacaagtgatgtcacttcttccgccaggcgtttttgcgcttcacgtttttctggcgccgtttctgttttttcagcgtatgcttcaatttcctcttttgaaaggaacgtaaagtatttcaagtatttgacaacgtcacggtcgtctgtgttgatccagaattgatagaattcatatggcgatgttttttctttatcaagccagatcgcgccgccttccgtttttccgaacttcgtgccgtctgcttttgtgacaagcggaatcgttaggccgaacgcttttgctccttcttcttctgattttctgatcagttcaagacccgctgtgatattgccccactgatcgcttccgccgatttgcagtttacagtttttgtctctgtaaagatttaagaaatcataagattgaagaatcatgtagctaaattccgtgtacgagatgccggattcaattcttgagctgaccgtatcttttgccagcatgtaattgatgccgaaatttttaccaacgtcacgaaggaaatcgatcacattcattttgccgatccagtcaaagttgttcgcgatgacagctgggttttctgctgcttcaaaatctagaaatctggacagctggtttttgattttttgggaccattcggatacgatgtcagcagtgtttaatgtacgctctgctttttttccgcttggatcaccgatgaggcccgtcgcgccgcccacaagcgcaatcggatgatgccctgcaagctgaaaacggcgaagtgttaaaataggcagcaggtgtccgatatgcaagctgtctgctgtagggtcaaagcctgagtacaagcggattttttcttcattcagctgtttatttaacccttcttcatctgtcatttgctgaatcaatccgcggaaggataagtcttcaagtaagttagtcataagataaagctcctttttgattaaaataaaaaacgccccttcgtttacacgaagggacgattgattatcgcggtaccaccctactaataagagaatgcaaacattcgtcttatcactttgcctgataacggatcaggtccgttctttcactactgaaagcctggccggctttgtttgcaaaagcggttcatgagtgtattcgatatatccgtctgtgctgattttcaccggccatcagctctctggaacgtaaggatattctacttgtctcaatctttaccttttcatatgaagctatatcatttttaacataaataaaatcctgtgtcaacgccgccttttaatcctccattgttgacagatctccagccggcagattaagctcccatgccttcagcacgcgcctcatgatctttccgcttcgggttttcggaagcttatctttaaattcgatctcacgcggagccgcatgggctgcaagaccctgctttacaaataggcggatctcttctttcagtttatcagacggctcaaatccttccctgagtgcaataaaggctttaatgatttctccacgcaccgggtcaggctttccgattacgcctgcttctgcaatagccggatgttcgacaagcttgctttccacttcaaatgggccgacgcgctcaccggaggtcatgatgacgtcatcaactctgccttggaaccaaaagtatccctcttcatccatgtaagcagaatccccagacacataccagccgcccggcatgaaatacgattcatacttttcagggttattccaaatggtatgcatcatggaaggccagccctttttgatggcgagattgcccattcggtacggcggaagctcgttgccttgattgtcaacgatcgctgcctccactcctggaatcggcttacccattgaacccggtttaatatccatgcaaggatagttgcagataagctgactgcccgtttctgtcatccaccatgtatcatgaattcgtttgttaaaaactttatgtccccatctgatgacttccggatttagcggctcaccgacactgagcacatgccggagtgaagttagatcatatttcgcagccatttcatctcccgctcccatcagcatccgaaaagctgtcggcgcgctgtaccagacattgacgccaagctgttcaatcgtaccataccagctttccgggctgaaacgtccaccgacgatgacatttgtcgctccgttcagccacggtgcaaaaatgccgtataccgtacctgtcacccagcctggatcagccgtgcaccaataaatgtcttcttcctttaaatcaaggacccactttcctgtttgatattgctgaatcatcgcttcatggatatgcagcacgccctttggcgtaccagtggaacctgatgtatagtgaagcagaaagccgtcttttttatccatccattcgatatccagtcttgtgctttcctgtttcgctgcttcatcataattgatgatattcgtgccgctctcagcctctcccccgactacgaagacatgctgcaagtgaggcagtttgtctaccggtattctctccagcagctcaggtgttgtgacaacaacctttgcctcactgttttcaagccgatctttcaccgctccctccataaatgcttcgaacagcggcccggcgatggcgccaattttgattgcgccaagcataataaaataaagctcgggtgatctcggcataaaaataaaaacgcggtcccctttttccacatttccataccgtctcagcacattcccggctctgtttgattcttccttcatttctttaaatgtgtatttttcatcccgttttgcgtctttataataaagcgctactttgttttttcgaaacgattcggcatggcggtcaatcgcttcatacgccgcattcagtttccctgtctcatgccaagagaaatgtttctctgcctcggcccaatcaaaatgccggtacgtttcttcatagttttttaagttatgatccccctctattgctggtaacgctttcaaattcatgcccaaacatccccctttgctgaagttgtcacaattattatagtatatattcatattcttctcaatttttaaaatataaaccaggttgaaaacgctttataatttggtattcttaaagaaggcatgtatttttgataagaattgatgggacggtgaattagtggaacatcataaaacataccattcagcaaacatcaaaacagcaaccggctctttactgatagaagggcctgtctctccagaggatttggcaggttatgagtttcataaagatttaaccgcatttcgcccgcctcgcgagcagcatgaagcgctagtcgacattgcaggccttcccgaagggcgcattattattgccagagacggccgaaccattgtcggctatgtcacgtatttatatcctgacccgctcgaaagatggtctgaaggaaatatggaggatttgattgagctcggagccatcgaagtagcgccggactatcggggatgcgctgtcggaaagacgctcctgaccgtcagcatgatggatgaacaaatggaaaactacattgtgatgacgacagaatattactggcattgggatttaaaagggatgaaaaaagatgtgtgggaatacagaaagatcatggaaaagatgatgaatgcaggcggattggtctggtttgcaacggatgagccggagatcagctcccaccctgcaaactgtctgatggcccgcattggaaaaaacgtcagccaagaatcaattgagcaatttgacaggctccgtttttatcatcgttatatgtattaactgacactgacaaaggggaaaaaataatgattgttgagcaaatcatgaaaagagatgtcattacattaacgaagacagatacgcttgaaacagccatatgcaaactgaaggaattccatatcagacatctgcctgttgtagatgaagaacgacacgtgatcggcatgattacagacagagacatgaaacaggccagcccgagtatttttgaagaaaacaaacgaagcctatttctcacacgaagcgtagattcaattatgaaaaaggatgttgtctgcgcccacccgttagattttgtcgaagaaatatcagccgtgttctacgagcatggcatcggctgccttccagtggtgcaccatcaaaaattaataggcattttaacaaaaaccgatttgctgcggacgtttgtcaaattgacaggcgctgaccagccgggatcgcaaattgagataaaagtaaacgacatcaccaaaagcctcgctgagatcagcagtctttgccaagaccttcaagtgaaaatattaagcgtgcttgtttatccgcatgacgatcccggtgtaaaagtgcttgtcttccgtgtaaaaacgatgaatccgctgccgtttttgcaggcattacaaagaaatggacaccacgtcgtatggccgtcagagcaaagggatctgctatgagagacagtgtatttatctattctccatcctaccaaacctatatgtttcatcaggagcatccctttaatcagcagcgggttctgttaacatatgatttgcttaagacgatcaatgcctttgatgatggagacattgtcacccccagactcgcttcagaagaggagctttcccttgtccacacggacgattacattcaggccgtaaagcttgcgggcgccggaaagcttcccgctgaagaaggagaaagctacgggctcggcactgaagacacacccgtctttgccggcatgcacgaagcggcatcactcttggtcggcggcactttaacggccgcagactgggtcatgtcaggacaagccctgcatgcggcaaaccttggcggagggcttcatcacggctttcgcgggagagcatcaggattctgcatatacaacgacagcgctgtggctattcaatatatccagaaaaaatatagcgccagagtgctttatattgatacggacgcccaccacggggacggtgtgcaatttacattttacgataatcctgacgtatgcacgctgtccattcatgaaacaggaaggtatttattccctggaaccggccagatccaagaaaaaggcagcggaaaaggatatggctattcctttaatattccgattgacgcttttacagaggatgattcttttcttgaggcttaccggacagcagcttcagaagtcgccgcgtatttcgagcccgatgtcattatcagccaaaacggcgccgatgcccattactacgacccgctgacgcatttatcagcaacaatcaatatatacgaagaaatcccccgtcttgcacacactttggctcatcaatattgcggagggaaatggattgcagtcggaggcggcggatatgatatttggcgtgtcgttccccgcgcctgggccagaatatggcttgaaatgaagggaattgacccgggatacgagataccgccggaatggattgctaaatggcaaaaacaatgccccgtggcccttccgtcgagctggagcgatccggctgatttatatcctccgattccccgcaagcctgaaatcacagaaaaaaatgcccaaactgtcagcaaagcattatatgcgatacgctctgaacagcaaagaacaaagtaaaaaacgacctttacgaagaggtcgtttttgattttttgatcactatttccacacgccgattttccttcatgtgttcatttgtcttgttatccttcaccggctttgtatccgcataaccgacagcaataaagcgcttggagggaagcttctcttttgacgtgaagtattgaatcactccacttgcccgtgctgctgatagctcccaattcgacgggtatcggtatgtcgaaatgtttcggctgtctgtatgcccctccacctgaatgtcatttggaatggtttgaagaagaacggcaatttggtgaagaagtgtttcggcatttttcagcacctttgcctcacctgtatcaaacagcacagcctcctgaagaacgagcacgacaccgcgttcatcccgtttggctgtcatttgggccttcaaatgattgtcttttatatatgtatttactttcttgagaagctgatcctgctgatcctcttgcttcttcgtatcagatggggatgtattctttttttctatggatgtttggtccggctgaagcccgttgccttccttctggatcgagtccactgcagctttgaatttttgcagatcgatttgggacatcgaaaagagtaaaataaagaacacaaggatcaaggtgatcagatctgtaaaggttaccatccagctggatgaagattgactgttttttccgcttccattccttctgtcaaaacgttctcttctaagcttcatgtacagatcccttttttgtttttacttgttttggctgcttcttccattcttcccgtgagctgaaaacgaccagctggctttcaaggttgcgcgggttttttccggattgaacaccgataatcccttccaccattacctgcttgatgaaaatttcactttctgttttctcttcaagcttagccgcgatcgggttgaagaccatatttgccagtaatgaaccatataaagtcgtcagaagcgcaatggccatgtttggtccgagcatatgcgggtcgtttaagtttttgagcatcagcacaagcccgacgagtgttccgatcattccccatgccggagcgaattctcccgctttttcaaaaactcgccgcccttttcggtgccgttcctccattgctgcgatttctgaatccatgacgagccgaatcgtttcttcatcccagccgtcaatcgctaaaagcagcccttttttcaagaatggatctttgatttcccgagcctgatcatccaatgataaaagcccgtgttttcgcgcgtgatcggaaagggaaacaaaggttttcacaagatctttcacattgtcttcctggcggatgaatgcctgctttaacacagagggcgcttttttcagctctcttggcggaaaactgataaaaacagcggcgcaaagtccccctgttacgatgaagaaagaggtcagatcaagaaaagagcggaaaccgcttactcccgatcctgaaataatcccgataacaataataatcgttcctaacacaaatccaacaggtgtaagataatcaaaacgtttcatcatttctccccatgaaaaaagcaagaattcaccataaaggtgaagcttgctctttgtttttcttatgacttggttgactttctaagctctatacggtgcggcagttcgacgatatgctcttcaaccggctctttattcatgagcttcgtcagcagtctcatcgcaacggcgccgatatcatatgtcggctgaacaactgttgaaagctgaggacgaaccatgaggcttaatcttgtattatcaaaaccgataatgtcgagatcctccggaatggataagccctgatcctgagcggcatggataatgccgagtgccatttcatcagttgcagaaagaatggctgtcggttttttatccaggctcatcagatgctgcagtgcttcgagtccggaatcatatgtgtaatccccttcagctacaaattgttcattaaacggaaggttcgcttcttcaagcgcacgtttgtagccttggagttttttcgaacggttgatcggttctgccattggtccggaaacgaacgcgatgtctgtatgtcctttatcaaccaaaagcttcacggcatcataaatcgcctgttcgtaatcgatagcgactgacggtgtttcctcctgctcttctacagaagcggcaagtacaatcggcactggagaacgcttaaattccgccacatgctcgtccgtaatgtttccgcccataaacacgatgccgtccacttgtttgccgagcattgtgtttaacaagtgcagctctttctccatgttttggtcagagttgctcaaaataatattgtatttatacattgtcgcgatatcttcaattccgcgcgcaagctctgaatagaaaatgcttgagatatcgggaatgatgacacctacagttgttgtttttttacttgccagtcctcttgccaccgcgtttggacggtaaccgagacgttcaatggcttccaagacttttttcctcgttgtcggttttacattcgggttgccgttcacgacacgggaaacggttgccatgcttacattagcttctctcgctacatcgtagatcgtaatattgctcatcctaaaaccactccttttactggatacacttatccttatctatagcataaacactttatgtagagaaatgtcataatgtccgaatttatgtcgtttatgatttgtaagcgtaagtcagtagtgtacattatttttcattattcatcaaatttaattacttctcatgaaattatacacgtttttatagatgatgaaaacgtatacttggtttttataactaaataaacgagaaagcataaaaaaaggccgcaggcgcggccttttggattgttcaattaagcgttgactttcaccattggcttcagttcattcagccatttttcgaattcaggaatcgccatttgctgagcagagtcagaaagtgcgactgacggatcagggtgaacctcagccattacgccatctgcaccaatcgctaaagcggctttagctgtcggaagcaagaggtcacggcggcctgttgaatgcgtaacatcaacaaagactggcaaatgcgtttcttgtttcaaaatcggcacagctgaaatatccagcgtgtttctcgttgctgtttcatatgttctgattccgcgctcacaaaggataatttggtcattcccttgtgacatgatgtattcagcagcattgatgaattcagagatcgttgcagcaagaccgcgcttcagaagcactggctttttcacggcgccggccgctttcagcaattcgaagttctgcatgttgcgcgctccgatttgaatgacatcaatgtagtccagcgcttcttcgatatgagccggagttacgatttcactgataaccgccagatcaaattcatccgctacacgttttaaaatttgaaggccttcaacaccaagcccttggaaatcgtatgggctcgtacgaggcttaaaggctccaccgcgcaaaattttaatcccttgttttttcgcagctgcagcgacttcagctacctgctcatagctctctactgcacatgggccgacaatgaatctttgctggccgtctccgattttttcgcctttgatatcaacaattgtatcttcaggttttttcttgcgggagacaagcagcgctttgctgtgatcttcttcctgaagctctaaaccggctttgaatatctctttaaaaatgtgctggatggttgaattttcgaacggcccgtcattgttttcaatgatattgtttaacattgtgcgttctctgacagggtcaaatcggttgacgccctgtgcttccttcgctttaccgatctcttttacaacatttccgcgttcgttgattagttttaaaatttgtaggtttaattcgtctgctttctgccttaaaagctctaactctgtgttgctcatttttttcatcctttccctgcacattcattttttattttgtagttatcatgcatcttactataagtaattccaaatggaaatactgaaatacaaaaaattttataaaaactctactttattacccaaacgcttttaagtgataaagtaatctatgaagctatcctacatgatgtgagggcaatgttcaagggttttttacaaaaaaaagcgccagatgatatctggacgcttttttctatgacaaatgctgctcaatagcggcttctgtaatttgtgaatgtgaggtatgccatttcacttcaccgttctggatgatgaatacctgagggctttcatgcttgaccccatatgtttctgcaatgaaattggacagcggccgggcttcttgtacttgaagatagtaagccggcacatcctcatgctgatttgcaaaggcatcaaactcatgaaatgctgcctggctgatcgggcatgtggtgctgtgtttaaagaagacgaaaacgccttcctgttctgcaatccgtttaaattcttcctcagattgaataagctgtttagccatgactcaagctcttccttccctgctcagcgattcaactgctcagcctgtttttgtgcatctttcagttcgtcttttacatcttctttcgtctggaggacttgatcttttgtttcatcagccgcctgcatcgcttcttccctcatatcctgcattgcagtcgatgaatccgttttgtcagatttggaacggtctctcaaatcctttaccttgttcatgatctgtccagactgatcggctacaagctgtgtgatgttggaagttttgtcttttgcgatgctgacatattgcgtgcctttttccttcgcatctgccgtcattttatcagttttgtcccgtaaggcaacagcctggctgccgagatcgtcgcgaagttctttgcctgatttaggtgctagaaaaagagctgtagtggcaccgatgattcccccgattaaagttccgattaaaaaatctttactattaattccatctttgctcatcattattcctcctcttagtatttttttctcttacagggctgattttttcttttgcttccatttctcccaaatttccattgctgcttgactccaagtgacaacttgattgatcttatcttgattttctctaactgatgccgatacagaccctgccgcttgtttcatggatgtattgaactgctgtacagaagctcccactccttgaacagcatgaacgaccgtgttcagcttttctgatttttcctgaatatcttcagccaggcggttggtcttatgtaaaagctcggctgtttcagttgtgatgcccttcatttgtccctccagcccttcaagagtggatgcgacgttttttagtgtcagctgcaatgacttcagtgttttagacaagtagatcactaatacgagaaatgcaactgcgatgagtgcaacgctcaaataaagaataataatcatctcaaacctccttgctgcaggatatactgctgtttacccgttttcttcaatcataaacatgtgtactgggctgtatacatactattctccgttatgtaagaaaatcctttaataagcttttccatcagataaataaaaagcagtgagatcactgctttttattatgccatgacgttttcgtaggctctcatatatttttggatatctcctgctcccatgaagatgagaacggctttatcatgagcttttaaaacagatgtgtcatcttcttcaatcagcttggcattatgaatttttccctggagatcgccgatcgtcagctttccggcattctcacgggctgagccgaaaatatcgcataaatacacacagtcggcgccgctcaggctttctgcaaattcgtcaaggaactgctgcgtccgtgtaaatgtatgaggctggaataccgcgacaatttcccgatcaggatacttctgtcttgccgcctcgattgtcacttttatttctgtcggatgatgggcatagtcatcaatcagcacttgatccccaagctgcttctcattgaatctgcgtttgacgcccccaaaggatttgagagcatgcttaatgatgctggaatcaatttcttcataatggcataacgcaatgaccgccaatgagtttaatacattgtggtggccgtacgcaggaatataaaacgtatcatagaacgtattgcggacaaagacatcaaaagttgtcccttccgtgctttttacgatgtttctcgcttgaaaatcattttcttcccccgtgccataatacacaaccgggacgttcgcatggattttcggcagatgctcgtcgtctccgcaggcaataatgcctttgttgacttgaagagccatctcttggaaagcgtcaaatacatcgtcaatgcttgagaagtaatcagggtgatcaaaatcaatattcgtcataatcgcgtaatctggctgatagcttaagaaatggcggcggtattcgcacgcttcaaacacaaagtattcgctgttttcatttccctggcctgttccgtctccgattaagaaagacgtcggttttgcgttttggatcacgtgagccagcagacccgtagtcgacgttttgccgtgtgcgcccgtaacggcaacactcgtgaattttttcatgtagtcgcctaaaaacttatgataacgtatcaccggaattccctcagacatcgctttttctatttcaggatgcgtgtctgggaatgcgtttccggcgatgactgtcatgccgggtttaatattctccgcgctaaaaggaagaaccgtaatatttcttttttcaagcgctgtttgcgtaaaaataaatttttcgatatccgatccttggacagtatatccattatcatgaagtatttgggcaagcggactcataccggtcccttttattccaacaaaatgataaacagtcataattgtacctccaacaaacgtctatctgttccccagtatatgacgctcatttcaatttgcgaccgcggcggctgaaaagcctcccttagcggcgtattttatatgttttgttatgtttagtatcaggttatttctttccgattaaacccagatatcaagatttgtctatgcacagctgctgtaaagcggcatagctgttaaatgctctaaacactatcataccatgtttggtgtgaaaatgaacccatattattcgtttattaaatcacttgctgtgatcagcacctcccgaggcttgcttccttttgcctcagagatcatgccttccgcttccatcatgtcgatcagccttgccgcacgattgtaaccgattctgaatcttctttgcaggcttgaagtgctcgcactgttttgctctacaacaaactcacacgcttcgtaaaacagttcgtcctcttctttcagggcagatccttgtcttacgagctcttcttgttcaaataaataggtcggcggcatttggcttctgacgtgggaaacgacgcggtcgatttcccggtctgacacaaagttaccttgcagacgaaccggttttcccgatccgttttccaaaaagagcatatccccttttccgagaagcttttctgcaccggctatgtcgataattgttcgggaatcaacctggcttgaaacagaaaaggcgattctcgttgggatattcgccttaatcagacctgtaatgacatcgactgacggacgctgagttgcgacgagaagatggataccgcacgctctggctttttgggcgatccgcgcaatgctttcttccacatcgtttggagccaccatcatcaaatctgcaagctcatcaataatgacaactaaatatggcagcttttcacccatttggtgttcagcggttaattgattaaagcggtcaatatcgcggacacctgaatgggcaaaaagctcatagcggcgctccatttcctcaacgacccatttcaaagcagctgtagccgctttggcgtcagtaatgaccgggctgacgaggtgaggaattttattgtaaggggccagctctaccattttcggatcaatcagcagcacctttacctcactcgggtcagctttataaagcaggctgactaatattgtattgatgcatacgctttttccggagcctgtagcaccggcaatcaagccatgcggcattttcttcaagtcgataacaacaggatttcctgaaatatctaatcccagcgcagctgtgagcggtgacttgcttgtcctgaaagctgagctgcgaatcatttggcgcaaatcaaccaccttgctcgtgcggttcggcacttcaattccgatcgtgtttttccccggaatcggcgcttcaatccgaatatctctcgctgagagactgagtttaatatcatcggacaagttggtgattttattcacctttacacctggttcaggatgcacttcaaatctcgtgacagacggaccctgggttacatggaccacattggcgcggacattgaagtttttcaaggttaaatcaagaagctgacgctgttcttcgatccacgcagtatcatcttgaacctgcgctggcgggacatcaagcagtgcaacattcggaaatacatagctgccgcggcgctcctctgctttttgctgtttatgcgtatctcttttcagcatcatcacattaaaaggaacggatggccctttttgagaagatgcgctttgttcagtccttttctcctgtacaccaggcctttttttcggctcttctgaagcttcgcgaggtttgtctgcgcgaattccctgccggttttcaagagttgcagtaaacgatttggaaccctgctccatgtgttcagttttctcaagctctgtatggctgtctggctgaacatctatcttcgtttcctgagcctctcccaggatgtcataatgattatttattatgctgtctgatggctcttctgattcttttgccacagtttctgcttgagccagagcctctgatgaatactcatgatcagtaaataaaggctcttcctgacgaatgtccatttgttcttcttgaacgaacggggactcagcaccttcttccgcgttttcatgatgattgtatactgggctgtctgacggctcttttgctttttcatcctcagatattgcctctgtctgagattcaggagctgtttgctcttcatcaagttcagcggagaaaacaggctcttcaaatttctctggctgctgctccctttgttcttcctcagccgttgcaggctcttcgcggcctacttcactgtctgaaagcccttcagccgccgtatctgtgagcatctcaggcggtgtttgctcttcggcatgttcagctgggaaggaaggctcctcttcttccggctgttgaacgcctgactcaaatggcactttgttacctgacggctcggctggccttttcgccagcgcctcatcattctccgtatcctttctgtttaaaacgccagaaggctgtttttcaaattgggtatccgggaagaaaggactttcttttttggaatgcgcctgtgtgtctgaagcaggatagccgcgttcacgttcgatctcttctgacagcagtgttaccttctcttttaccgatttatccggttcgttcaatgtttcagaaggctttttcggcacatcctttttaacagatggtttttgattgaatccatagacaggcgaagggatatttgtcggtttaaacggtttcttcgccggctctgctgcttgatatgtatgctgctcttcttcatttctgggacgctctctgtaaggtgcagcacttggacgaggcgcggatttcggttcgtccgatggtgtgcggcgccttctcaggtcatgatttttgtatccgtcaggcacgactggaaaacggaatttgccttttggatattcataatatattttaggatcttccaatctttttaattgtccttcaggatgatgtacttcttgttgctgcggaatttgagcgggttttgtctcccgttcagcatcctcttcgctttcgcctaaaaacaaatcaaaaaatttatgaagccaactcataatttatctctaactcccttatagttttctgggacggtttttagtataccactgctggtcggcccagaaaagattaagctatcagcagaaacaaagccgctaaacaagggcttagcggcttttcacatgattcgttttttttggcggatttatgggagtctaaaaccgaaatgcgtctcctgcctcatagtctccttctaacacaaggattcctttttcagcaggggcatccggcaaatcaagctctttcgctgagcagatcatcccgcttgacggaacgccgcgaagctctgcatccttaatgacaagtccgctaggcatcacagcaccgactttggcaacgacaactttttggccttggtcaacgttaggcgcgccgcagacgatctgaagcgtttcttctcctacgttgactttacatacgcttaatttatccgcattcggatgtttttcttttgattctacataccccacaacaaacttcggagataaatcaacgactaatgtttcttcaacgccgtttctgtttaaaatctcattcacatcttgcacgaatgtttctgagagcgcaacagggccgttttcatcaatagtcaagtaagaagacgcgttgaaaatgttgaagcccgttgtttcttttgtttcgttattgaaaattttgacgacgtcgccgtgtttttcatagcctaattgttcgcgtgtcacatcttgaagagagatcaggagcgtgtctcccacaccttctttattataaaaagcgttcataagtaaaaatcctttctaatcctttttcggacggcttttcgccaggataaacaccggttccagctttccttcattgtacaaaaatgaaagggcggtaatcgggacggtgccgcctgcaaagaagctcatcgacatttgtcctagaatatcataccccgattcattccggatgtcagcaagaatcaaaacgtcctgatgaggaacagagatcgccagctccccttctgcatgctgcttatactcatttaagatcgcttcgttcaaaatccggcttgcgtcgtatccgtcgtttgccctgaagaaataaaagtaattgccggcaaccgtatcttctttgacaaccgtcggcagggaacggagattaaatgcggccgtctctctgatccgctcttttgtccagttttctttctcaagcatgcgctggtcaattaaacggtaggttttcccgagatcaagcgcgtaataaattcttgtctctgcggtatgatcgtcataaatgagcgggatatcttcactggacttgtccgggaaggaagtcgagcggatgaccggataaatgcgagtttctttcccggtcatttcctgagccttcccttccattgccgtcatcgcttcagagacatagtacacgatctcatcaatggcttcgtcttttttcagttcccattttgcaataatcggcggcaaatcgagtgtaatcccttttttagtcgtttgatcctcaacacggagggtgtctttttctctgtcaaacagaaaggagcgattctcgtgctgaaggcgctgtttcagtatatctgacagcttccttgaggtcattttcaaaccgatgtcctcctttacgctttagcgagagagtctgttaaaaactgttcaatttcttcttttgttttgcggtctttgctcacaaaacgatttacttcttttccttcattaaacaccacaaagcttgggattccgtaaatttcccactctgcacatgtatcaatgaatttgtcacggtctacgtagtagtaggtgaattcagggaaattcgcttccaattcaggcaggaaaggctctacaaaacggcaatccgggcaccaatcggctgaaaacataaatacagaccaatcatcctttaccgctttttccagctcttgagttgattcaatttttttcatttcatatccctccagttgtttatgttcttacatgttttttatcgatactcgtccatttggatcataccaaactgcttgaggcaaaaccacttatatgcaacgaatgaatatgtaagattggctttcccattatcattatcatattttatttgcattatcaagctcgtttcgtttaacatcgtgtacatgagggtaaaatttacagatggacatacataaggagggatttttatatggagtttatcgtctatttagcaggagaaatccacagcaattggcgcgaggaaattaaagaaaaaacaaaatcactgaagctccctattacgtttgttggcccgatggagaatcatgaccgctcagacaatattggtgaagaaattatgggcgtacagccaaatgccgttttaaaggatgacaaagcctctgacatcaacaacttcagaaccgccgtcctgatgaataaagcagactttgtgatcgccctgtttggcgaaaagtacaaacagtggaacacggcaatggatgcatcatatgcgatcgcaaaaggaaaacccctgattatcatccggccagaatcgctccaccatcctttaaaagagctttccaataaagcgaatattacggttgaaaccgttaaccaagctattaaggccctttcctatctatttgaaacagaataagaaaaaagcttgtcgatccgggcttactgctcgttcaacaagcttttatgaaacctacatattttctttaatcgcatccaccgtctgcttatcgcaggctgttacaagtttgatgagcatttctttagcagcagcataatcatcaatatgaatgatagaagcgtttgtatgaatatagcgggaacatattccgataaccgctgacggcacaccgctgttcgaaatatgaaccttgcctgcgtctgttcccccgccggatacaaaatattgatatggaatatcatgcgtttcagccatatcaagaacgaattccctcattccgcgatgcatgactgtcgttctgtcaagaatgcgcagcaaaaagccttttccaagctggccgaattcatttttgtctccgctcatatcgtttgccgggctggcgtcaagggcgaaaaacaagtccggtttaatcatatgagaagccgtctgcgcgccccttagccctacttcttcctgaaccgttgcacccgcatagagtgtattcggaagctctttaccgtgtaattccttcagaagttcaatgcttaagccgcatccatatctgttatcccatgcttttgataaaattttcttttcattcgccatcgtcgtaaacggacaaacaggcacgatctgctgtcccggtttaatgccgattttgatggcgtcttccttatcatccgctccaatgtcgatcatcatgttcttgatatccatcggacggtttcgctgcgcatctgtcaataaatgcggcggtatgcttgaaatcacacccggaaccggcccgttatctgtttgaatttcaacccgctgcgcaagcaaaacctggctccaccagcctccgagcgtctggaatctgagcagcccgttgtctgtaatggatgtcaccatgaagccgacttcgtccatgtgcccggctaccataattctcggtgcgtcctctgcgcctcgtctgactccgaaaacacttcccagtctgtcctgaacgatgtcatcggcatatttggctagctcctgcttcataaaagcacgaacctgatgctcattgcccggcgcgccgggaagctgcgtcagtgtttggaaaagcgctttcgtttcttgattcatgttttcccctcatttctatgtagtccttttattttattagaaacaatgaagttttccaagcaccctgacccaatctgctcgatcagccgcgtattgcttaacaggatttggctgtttctgtataatgaaaagtacgatcaaccaggaggtgctttattttgaaattgcgtcatcttcttttaggagcaggacttggaatttgtacggctgtcgttgtgaaacaatatgtgatgaagccttatatttcttcagaaaaagcgcttcgaattgtaaagtctgcttttaagcagcggggcccgattgacggatcatggatttacacccagccggagccttacaatattaacggagaaacggtacaggtatacaaaaccggcattacacgatcagctttcggagaattagaacagtatgaagtcatggtggatgcgaaaacgggagaaattgttgatgtcattgatacaatcgcctcttaacaccggacaagcaaaaaatagaagccgctgcctacgcagcggctcttttttattatatcgcgcgaatcggtttgtataccggataccacatcgcatcctgcactgcctgtataatgtcttcaggctcttccgtagcgacgccttccttcattgcggtttttgcaacttcaacagcaacggttgccgaaacagtgcgcaaatcttcaacttttggaagcatcggcgcgccaggcaccccgacattgaccatacctgcgattgcccgggcacatgcttcaaacatgccgtcggtaattaattttgatttggtaacaatcgttccaagaccgagaccagggaagacaagcgcgttgtttgcctgcccgatatgatacgtaactccgttatattcaactggcgggaacgggcttcctgtcgtgatcagcgcacggccttctgtccattcgattaaatcctccggttttgcttcagaaagagttgtcggatttgacattggcaaaatcgccggccgtttcacatgtgacgccatttcttttacaatttcttcagtgaaagcgccggaaaccgtagatgtgccgatcaggatcgtgggtttcgcctgccggaccacttcaagaagatcaatgcctccgccgtctccgttccgctgataatccttcacttcttcagccgaacgagcatacggcttttggaaatcaagaagctgatccatatcatctgttaacagcccgtttctgtctatgcaccagaagcgcttgtatgattcttcttcactcagtccctcgcgcaccaatgcttcccgcagctgttcggcaattccgattcctgccgttcccgctccgaatataacaactctgtgatccctcagcggaactttagacgcttttgcacaggataagactgcggccaaagaaacagcgccagttccttggatatcatcattgaaggtacacactttatctttatagcgtttcaaaatgcttcgcgcgtttttcgccccgaaatcctcccaatgcagcaatgcattcggaaatgtttctctcgccagcgcaacgtagtcgtcaataaattggtcatagcgttcgccgcgcactctggaatgctggttgccgacataaagcgggtcgttcaagaggctctcctgatttgtccccgcatctaaaacaactgccagcactctgctcggatcaatgcccgcagccgctgtataaaccgccagcttgccaatagaaatcgcgattcctccgacgccccagtcaccgattcctaaaattccttccgcatcagtggcaacaattaaatcgatcgtatcgctttgatctttatactgtttaaatgcttctttcataccgtccgggtcatcgattgacagatagagccctcgtggttttctgtattcatggctgtatctctggattgccgttccaactgtcggtgtatagacaatcgggagcatttcccctaaatggtcatttaacaggcggtaaaacagcgtttcattccgatcgtgcagcgccgttaaatagacatttttgctcaaatcgtcaggctgtgcggaatattgttcatacgctcttttcgcctgatcatcaattgttaataccttgggcggcagaaagccttttaaaccaagttcttttctttcttcctcagtaaaagcaacacctttgttcaaaaaaggaacagagagcacttcaaggcctcttaatgttgtttgaatgtctccttcgtttgttactctgaattgtttcaccctgcctcttcctttctgagcataattagtactaggtttgcattattagccggaaaacatgcagggtaaacataaaaatatgctatcgcttcattcgcttaactgactttttgatacttccgtcctcctcccattgaagggcgcgatactcggcatcatggtaaaaaataaaccaagcatctttttctgctgcgaacgcctgccatttctgcttttgcgggatagaggtcatcggataatcatcgtaagccagcacccatagcggattgcggtgggcatgtgtcggcatcagatctgccatatgtacggcagtttcacccgcatcctcgcatatcaggacactgtgtccgtcgctatggcctccggtgtgatgcattgtaataccctctgtgatcgttaaggtgtcttcaaaggttttgacttggccagctacagcctcccaattttctttccaatacgtatttttcgacctgatattcggatggcgcatttcgtcccattcaacagctgatgtataaatcactgcattcggaaagacagagacgagccgttcaccttcatattccgttaaaccgcatgcatgatcaaaatgaaggtgtgtcattgcgatcacatctatatcggcaaccgttaatccgagtgcagctaatgagggtttcacattcgactcttgtgtcacgccatagtttcgtttttgtttatcagtcagcttgccgtacccaattccggcgtcaacgatgatattgagcccatccttttgaatcaaaatagggtctgtccttagttcaatctggtttttttcattgactggatattttttagaccaaagcggctttggaacgacgccgaacatggcacctccgtccatatgcgtcacgcccccgtcaagccaggtcaacgtgatattaccaattttcattgtttccattttcatcccccctgtcatcatggtagcaaacggcccataaaaaaaacagactcctgtcagagtctgtctttacgttctccattcaacctcagcccgatagatcggctggccgagtgcagagaatttttcttcatattctgtcataatattgccttccagattgctgttatgcaaatcgaggctgacgtatgtcagcagcaggccgtactcagagaagctcttcaaagagtactcaaataaacctcggttgtccgttttaaaatgaatcgatccgcctttgcccattacttcttcatattttttgaggaagtgggaatatgtcaagcggcgtttttcatgccgtttcttcggccaaggatcagaaaagttcaagtagacccgtttcacttcccccggctcaaacacatccgtcagcgtgtccgcatctatattcagaagctttacattctgcgcttcgctgtcttttactttttggacggctgtcacgatgacgcttttaaataactcaataccaatataattgatgtcgggattttgtttggccataccagaaataaattggccttttcctgtaccaacctcgatatggatcggattgtcgttgccaaacactgtgttccatttccctttataatcagcaggattgctgatggcaatatctgcgttttcagccaaaaagtcatcagcccaaggcttgtggcgcattctcatatgattgacacctctatctattatttcgactaacaacataccatgaattaaaaagacccgcaagctcgtttttccagtgtatctctcttaaggccgagcgcataaaaaaagagggtcccgtctgctggaacactcctttcacatgtataaaaacgctctgttttgaacaatttaacccgtatgatactgaagggatgtgtaccgttatgggtttacattatgagcatcaagttcatttattgaaggatatcttgactgaccatcaattggactgctgcggaacagtcgcagagtacgagcagcttgagcgtgtgattaaatcactgatggcaaacaccgagcttgattcaaatttcaaaaacgtgcttgaagatgtttaccgctacagccaatcaggaatatcgtccaaatccattgactcacacatacaagagcatcagaacagcctgtctcaatgggtagagcaaatggattcgtattcctgattaatcaacaattcgtttcatgaggatatgcagctcttccattgcatcatgaaattccttatcattgccttttgctttatgccaggcaatgaaagtaattgtttcagataacacataccaagccattcgcaaccgaaggctttctgtcagctctatgccgtacatgctcagccagctctcccaagctggcttttcgacgtagtggtacagcaaaggcccgaggtccatcgccggatcagcgatcatggcgccgtcccagtcaattaaatacagctggttgtcttcagacaatagccagttattatgattgacatcacaatggcaaacgactttctcaccgaaatgcacttcatgcaggtgttcttccaaatacttgatcccttcttgaatcagcggcgaagattgctgcacagcaaatacagcctgcttcagctgagacaaaagagcccccgggttcagcggttcttttccaagtctcttcagcatgtccagcaaggcttttgatgtgtgtattttacgaagcaattcagcaacgggccgtccgctcatgtctttaggcttcagctctctgccggtcatccagtgctgggccgtaatgacgtccccattttccatccgttttgtccaaaccagcttcggaacaatgccttcggcggataaaacagctaaaaaaggtgagctattacgttttaaaaaaagctgctgcccgttatgtttcgcataatatgcatctcctgtagctcctccggcggggaagatctcccaatcgctacctagtaattgtcccaaccagttcatatcaatgttcaacccatcatttcttaaaatattttagaattaaggctaatcgtttctagtctatccagcgaatgcctttttcgtacgaatcgtataaaaataaaaaagacagctattgagagtctcatatgctaatcaatagccgtcctttaaattttagcgctatagcacaaacttcgtcaagcaaaactcttaagatctgatgctaaatataagataaccgttccgatgccgtttactgcaaccgttttcttgatttctgccgggtcttcctgaaatcctgatggatcacataaaagccgataaggtatgtcgtttggcagcctccactcgacggagtctggactcgcgtgatggataacaatgatatctttccattcgtcaacctcgtcaagatcataaagcctgtatgcgataaggtgttcttttagcgtcaagcattcaagatggcgccggatgtctgcagcggacctaagacggaatgcaggatgcgcttttctcagcgagatcagcctgcggatatagtgaacatcttctttgaatgtttcgcggcgatcccagtcgagctggttgatgctgtcactggattgatagctgttttccactccctgcttcgtccggaaaaattcctgaccgctgtgaataaacggcaccccttgggcaagcaaaataatcgcggctgcaagcctttgcctgcttcgctttcggctgtcattttcttgaggaagcgcgaagctcattttatcccaaaaggtgtgattgtcgtgtgattcgacataattgatggactggcttggttccggaacaatcggtgctaatgccttccatccggaagacccggcaattccatgcatcacagcttgtgctgattcactgctgccgagcgcaaaccctgctgccttaaggtgaaaggtgttcccttttacagcgtcacgaaacatatcattaaaaaagccgatgcccggcattcttggcgcgttcgccaaagcagctttctgttcatgcggcagcggtgtagccagatcccacccttctccaaaaagcaggattccgggctttgccttagttgctttctctttcatataaagcacggtgtcaatatctaaaatcccgaggagatcaaagcggaagccgtcaacgttgtattcttcaagccaatagaccacgcaatccgcaatgaactttcttgccatccttctttctgatgcgatatcattgccaacgccggtgccgtttgatggcatcccacattcgtcgtgccggaaaaaataacctggcactgtcttttcaaagggggaattctccctcttatacacatggttaaaaacaacatccagaatgactcgcagaccgtgctgatgcagggtattgatcatttgtttcagctctgtttttctcgtttgaggatcatgagggtttgaggcatagcttccctccggggcaaagaaatgaagcgggttatatccccaattgtatgcatcaagcggcttctcttcatcaactccggcaaaatcgttcaccggctgcaactctacatgagtaacaccgagctcttttatatacgccagtcccgaagaactgccgtttgcggtttgtgtatccgtttccgtcagcgctaagtattttcccttgtttatcatgccgctgttttcatggatggagaagtcgcgaaggtgcgtctcatagatgacggcatccacagggtgtgagaatggtttaagaggagcagtccatttcatttgatccgggcgcaagacgacgcccttctctccatttacagtcacagccttggcatacgggtcaactgtttccatccattctaaattgttgcagatgcaaaacaaatactcatacccgtgaaggtcacccgtgaccgtaacagcatagacacccttttccaagcgattcatttggaatgtgcgcccgcttttattggggtgtgaaagcttgacagcagctgaggttgcagcaggcgcccatactttaaatacggtatgatccgcggtataaacggcgcccagctctccgtcataataaaattcgtcatcaaacgcagccgtccggatgaccgcgccaatttggagatccgttttgtggccgctggatgctctgacgcaatggatttttccaaatgtcacaggatggtcggatacgcagacgtacttgtattttgcttcaagggagtattcctccctgacagccagaggaaaaactgttgtttctgtctcaagccgaaacggcggtgtcatgatttccttttgttcagcaggaatcagaacagtaatgatattcatatcatcgacatacgcttcgaagctgcggcggatgctgaccatcggaagctctctcctccaaacacgtttatgttttgatccttaggggtgaaggactagatgccagacgaaacggggtagtgcccatgatttctccgtcagcatggaacgggattttgtccttcgtgtaaaatgtaatgtccttcgctttaaacatcgtaacgccatccatctttgtatgttttccaaatgccatgagacataaaagccaatattttttcaaaaacggctggttttcaacgattacgatatcaaatgtcttctcgcgcggatttgctaggggcgccgccttcatgcctcccccgtaaaacggatggttggatacaacggcaaaccagacatcatgaaattcgcgcgtctcgtcttccgtcgtacaagctaacgtaaacggcttaaaggttgccgaagcgtgcaaatgagaaagcggatacacaagaaatcgaaggcggagaaaaagaaaaacccgtctcaacggaaattccatcgcctttttattgacatatgcgtcaaacccgatcccgatgtgattcataaaataaagaatctgtgatttatcctgaaggaaattgacgctccctaaatgaaaggttcttgttaacgggcgctttaccttcttgatttcctgtatcagatcgatttttttaatagagaaccctcgcgaaaaatcattatacgcgcccgccggcacaaagctcagctcaatatcgtcaacatctttcagcccgttgacaacttcatgcatggttccgtctccgccaatgacgatcaggcgcttcagcttatattcctgtatcgttgaaatctgtctggcgagcacctcggcgtgtcccggatgttcagttaaaaatgaacggtgctcaacctttcgtttgatcaattctttttgaatggacttccaaacacgcaggccgtttcgatgtcctgctgtcggattaataataaaaaaccaatggctcatctttctcacctgcttatgttatgagaaaaccgctcaaatcgttctcttttactccagccactcctgtctgcgataggagtcagacatgcagtaagacaatagagcctttgcagcctttacctgatgatgtttgatcggagcagtgtttttcttctgccgctcaatccattcttccgcgctccgcttatccgctatttctaagccgtatggcggctccgggtaatcgatgtacgacgttctgctcagaagcaattttcgaaccggaatctcagcctgtttttcctttacgatctttgacacaaccgagtccgtacgaaacaggctaagccctggatttaacactgatgcagtctgagaggctgttttcttgtcccaaaaacgatttttagaccctatgtagacactgtcttcctcagcctctaaaaaagaaacgcaataaatttccagaggagaaataatcacaatgcttaattcaaccgccgcctgctgaattttcagcacaggcttatacataataaaataagaatcaggcagctgctgggtcagataacgcaaaatgcggtcctgcttcacttggtttgagagttgagatatttctgaaagagtagagcttgcccatttgagctgaaaatcatataaatgccttttataaaaagaagcaagcgccaccctgctcttcgggagccttacatgaatatcttcttcgtcctcaaaccattggtgtctctcttcttgtatatcggcttttatctcttcttttcttcttttcaatgaaaatttttttcgtttctgcaccggttccggttcttcagcactggcttgcctttcttcatgctggcgctccgctgcttctactagtgaaagccagcgctcttttttcaaacgtacaaactggttgatataatggtacggatcaagctcatatctcgatatataatcatgaattttgatgatttgtgccatgtttgtttctccactccgcaatgaattaagataattgaaatttgaatatttcctcgtattttggtgattggttcaagtgtatttgaaagagcgaaaatcgttcagccatcatcgaaacctcgccgctttcaaacggaacatgagctggaaatccattttcgcctgtccattttcttgccagcgtcatatgaggatgatacggtcttttttccacttgaaagccggcctgaaggacagcctgcttcgtatgttcccgcagtctatcaagcgttttgtttttctttggctccagatgtaaaacgcgcggccttctgcggtcgccgaatacatctatcttgtcaaactcaattgaaaatgggtcaatttctgaagcaatctctgctagcgaaccttcaagcttctttatttgtgtctcatccgccgctccgagaaaaattaacgtgatatgatagtcaagcgggtgcacccatttttgaaacgtcaataccggttcgtttttcgcagcctggtagatcggatttgcaattccctcaggtatgggaacgccgatgaaataatgaggccgtatatctggcatccgtctgacactcccttctttgacagctattattttatcaataaagaggctgtgcggatagaggaacagtgtatgaaaacactctcgcacaaacgtttattatgttaggatattatatgacacttgttttattcagaaaggaatgacaatgttgaaaatcgttgcaaacacagctgatctgataggagatacaccgctagtgagattgaatcggcttcagccggaaaatgcggcacaagtctatttaaagcttgaatttttcaatccgagcggcagtgtgaaagacagagccgcttatcaaatgatcatagaagctgaacaaaacggtttactcaagccgggatcagttattatagagccgacaagcggaaataccggcatcgggctcgccatgaatgcggcagcacgcggatataaagcaatcttagtgatgcctgatacgatgacgaaggaacggatcaacctgcttaaagcttacggcgcagaggttgtattaactcccggagaggaaagaatgccgggcagcatcaaaaaagcgaaggagcttgccgaacaaattccgaacagctatattccaatgcagttcgataacactgccaatcctgatgcgcaccggaaaacaacagcgcctgaaatcgcccgggcaatagaggaaatcggaaaaccgctcggcgcttttgtcgcctcctctggaacgggcggaaccattaccggaacaggtgaggcgctcaaagagctttttccggatatcacggttcatgttgttgagccagcgggttcgcctgtattatccggcggaaaacctggcgcgcataaacttgtaggaacgagcccaggctttataccgccgattttaaatgaggacgtttatgatgaaattatcaaaatctctgatgaagacgcgtatacgacgacaagacggcttgctgctgaagaaggaattcttgtcggtccttcatcaggcgctgcctgcttcgcggcaatcgaaacagcgaaacgcctctctcctgacaaagttgtggtctgcatgacagctgatacaggagaacggtacttatcaactgatttatggtcatttatttaaaaaaaggactggcttcagcagaagccggtccttttattttgcaagctcgtaaatggcctgagcatataacgctgtcgatctcagcaggtcatcaatttcgatatattcatccttttggtgtgcgctgtcagggcgtccggggaacagcgggccgaacgcgacaccggcttttaaggatctcgcatatgtccccccgccgattgagattaagtcagcttttttacccagctggccttcataaaccttttgcagggttttgactaacggatgatctgcggacacgtgatgcggcttgctgtctttgaattctcccagatcaaattcagatgcactttcgaatgcatcgcgaatcgctttgctttctgctgtcacaggatagcggatattgatcccgagctcgcctccttgcccttctttatagcgcagtgtgccgacatttaatgtcagctcaccgctgatttcatcctcacagtcgatgtccagtttttttcctcttgtatcacctgagaacttatctgtcacaacttgcacaaaccgctttcctgcatcgtcaagctcagtctgctggagaaattcgcacaataaaatgccggcattgatcccattgttcggttccatcgcatggcaggaaagaccgtacatacgcaaaatgagctgaccgttctctattgcagcttcccctttttggtccgtcgtgcggagcatgtctttaaatgaagacagaatctcttcttttttcggcccttcaatgacagcttccgcagcgtcgggcaccatgtttaagcgaaggcctgattgaaacgagacaagcactgcctttggttctgcttgatttgggcggtgcggtataagtaaagaagcatcgatgatccctttttccgcattaatgattggaaaatcggcgtcaggcgcaaagcccattgttggcatttcttcatgcttgaaataatgctctacgcatctccaatcactttcttcatctgttccgataatcattctgactcgcttggacaggggcaaattcatgtctttcacgattttcagcgcgtagaatgccgccattgtcgggcctttgtcatcaatggcgccccttgcataaatccgtccgttgcggatttcagctgaaaatggatcactcgtccatccatctcccggcggcacgacgtcaacatggcaaagtacgccgataatgtcatcgccctccccccattcaatatgacctgcgaagccgtcaagattttttgttgtaaagccttctttttctccaagctccagcaatgaagtcaggctggcatttaccccttctccaaacggtttaccgggtccggcggttgtttcgtccatgacactgttgattctcaaaaattcctgcgtatcacgaattaaatcctctttttttctgatcacttcaacttcccagttcataatgatcccctttccgcaagaaatgacttgcaaaaaccaaataaaacgaataatattaatggtgttttgttaaaacgttcgtaattggaggatactatgtttcatctaaaagagcagcaaacatccataaagcaagaaatcatagcagggctgacgacctttttcacaatggtctatatcgtcgtggtcaatccggtcattctggctaacgccggggttcctttcgaccaggtgttcaccgcaacgattattgcctccattgtcggaacgctgtggatggccctggcagcaaattatccgattgctattgcgcccggcatgggcttgaacgcttatttagcctttcatgtggtaagcgcaagcgatggcggcatcacgtacgcaacagctttcagcgcagtatttacagcaggggttctcttcattattctatcgttaacgcctttaagaaaacaacttatagaagcgattccaaacaatttaaaatacggaatcacaactgggatcgggctgtttattgcttttatcggtttgcgtcaagcgggcattgtggcagctgatgagtcaaacctggtcactctcggcaatctgcattcacctggtgttattttaacgctggtcggccttttgatcagcgtggtcctgatggtgctgaatgtaagcggcgctttatttatcggaatggcagctaccgctttgatcgcctttttcaccggtcagctccattttccaaagggatttatgtcgcttcctcatttgccggaaggattgatgatctcaaatccatttatcgcttttggcgatgtcattcatcacggcctgtacgctgtcgtcttttcttttctattagtcaccatttttgatacgacaggcacgatgatcggagttgccgagcaagccgggctgatgaaaaacaacaagctgccaaacgtgcgaaaagcgctgcttgctgattcaaccgcgacaacagtaggagctgttttcggcacaagtccaacgactgcatttatcgagtcttccgccggtgtcgcagctggaggaagaacggggcttacggctttgactgtcgcggtgatgtttgcggcttcaatgtttttcagtccgcttgtcagcgccttgtccggtatagccgccatcacctcgcctgctttgattatcgtcggcagcctgatgatgggttcagtttccaatatgaactggaaagagatggacgaggcatttccagcgtttctcgtcattctggccatgcctttgacatccagcatttctacaggaattgcgcttggctttatttcatatccgatcgtaaaagcggcgcggggaaaatggagagagattcatccgctcgtcatcgttttcgccattctgtttttcatccagctgtttattttataacatagaccaaaaaacccaaacgtcgccgtttgggttttttatgtaaacaataaagagacagcggccgctaaaaaacaacaggcggcaaacgcatagtgcaggatattgatacagctttttctggcccgataatattcatcactttccttatcggcgccaattaaaaaaggggcatccatgaccttgtcaaaaataagcgtcaggatataacggcaaacccctgtgtatactagcagcgcaatcaccttcagccaaattggggaaacaaatatgagaacagtgaaagctgacaatagcatgtacatctgcctcgcatactcgccattcctcagcatgactttaaaaaacaattccttatagcctgtgcagatcgttcgtcttttaaatatcctttttgaattacggtataataacggttttcttctcatcctgtcttttacttttggcattcccgcctcctgactcatcatcatcacaagtcctgcaagagcaagcctgctttttttctcttcagtcacctcagcttcaaaagccgtgaacgaagccgtctttttcaaactgcggataactgagaaaagcaaaaataaaatgccaaaaagcgcaagcaagtgccactgagtcaaaacaatcaggatagcagaaccagcaaaaaatatagctctgacaaaaatatcgccaatccatctcgaaatggagcgcggctttctgatcctgtcttgctttaaggataaaaagaatatatgaaggccaaacaaataagacaatagagcagtgctttctgcgaatgtgatgtgaacagaatgactgataaggggaaggacaataaaaaagagaagcagccatttagccagcgtgaccagaaaagaatacaaaagcgcgtaccgtttgagctgatagatgatttccttcttttgcagcaaaaacactttgtccgcttccattaaaaatgtacgaatcgagcctgtaaacatgatcagcccacacacagcgtacagccatctccactccgccacttcagaccactcataaagaaggcctcttccattcatcaaatcaatatactgatagatgacaaaagcaatcgccggcaaaacgatgtagagagcgactgtccagtcaatgaccgcatgcaacactttaaactgatacttgtaatagtcaaacagccttcgaaaaaagagcgtacgcccgttcatggccgatcaccttgaactgccttataaaaacagtcaagcaatgactgcccctctaatccggtcttgtcctgaatatcttttaacgtgccttggagaaataatgaacctttctcaatcatataaaaccggtcacagattttttccgcggtatcgagtacatgcgtgcacataagaattccggctccacgttctttttcagccttaagcatgtccacaaagcgtttcgtcgatatcggatcaaggccgataaacggttcatcaatcacatacatatccggcttagagagaaaggcctggataagcattagtttttgctgcatgcccttcgaaaaggtgacaggcagctcatgtttgacatgatcaagcgaaaacgtctgcagcaggctttgggcccgatgcgcaaattctctctcttcaatgccgtggagtgtgctgatcagatccaaatgctcccacagcgtcagttcttcgtaaaaggacggatgctccggaatatatgcaaatgaacagtcgttccaggcaatatgccctttaaaatcttctgaaaggccgagtatcgccttgattgcggtgctttttccggcgccgttagctccgatcagtccaaccagctccccttttctgacttccagaaaaacatcggtgagcactttttttcggcttgtatacccggcctgttctattgaagcttcaagcaaatttgtcaaaactcacccacctccaaaatttactacgaaacagaataaaaaaagtttctttaaccataataatattgagccgaaatacatagtaatccaacaaggatggctgcccaacgcgaattggaaaaaattaataggagttatccctagattcatcactgcaatatcgtgtataatgagggcgaattattttaacagttacagatgtctgcctttgttgctatttcgtacgcagttgatagtcgtgagttgtggttagtcaagtccatccgatcttatgatagggagtggttttttgaaaccttcaacaaaccgtatgctaactcgaatcaaatcagtttacatgtttatccaagaaaaaggtcttgtgacaacacaggaactggttgacgaattcggcattacacctagaacgattcaaagagacttaaatgtgttggcatataatgatcttgttcatagtccaagccgtggcaagtgggagacaacgagaaagaaagtaaagattacctcataaattgaaaaattacatagggccgcctgagagcggtccgatagataatagggcgaagaaactactgagccttgtttttgtgtgcttataaataaaaccccgcattcggtatgcggggtttttgtcatgcttgcggctcattgagcaaatgaagctcttcctctgtcagctcacggtattctccgggtgccagagcgggatctagggaaacgcgtcccatcgaaagccgcttcagataaaccacttcattgccgacagcctttgccatttgcttgacctgatggtattttccttctgtaattgtcaggtatatcacggtattgccactgtcgtttgttttgatttccgcttttgccagctttgttttatagccgccctctatgtagacacccgtttccaaatcggagatgtcttcccgagaaatctgtgattttaaatggacttcatacgtttttggaacatgctttttaggagaaaggagccgatgtgcgagctgcccgtcatttgtgagcagcaaaaagccctctgtatctttatcaagcctgccggctggaaatggctcaaatctcatctcctccggcgtcagcagatcgaccactgtttgctgccggctgtcctcagtcgccgacagcacgccctgcggtttattcatcataagataaatgaactctcgataatcaaccggttccccgtatacggtcacctcctgcgtatcaggatcaacgtgcgcctttacatctttggcaggtttgccgtcgatcatcacggctccagccttcacaacggctttgacttcttttctggaaccatacccgctgttggcaagcagcttatcaagtctcattcccaatctctcctttataaaagaaagcccgcagcatgcgagccctcagtttcatcatatctagttcatcagcctgcatgtctgcctttctttaagaaacctggcaaacggcggcctaaaattttctgtaaaaatcctaatcggtagccacaatacaggtagacagctccgccaacagcggccgcgatcaccacaacaatcgcagcttgcagctggccatcctgataggaaataaagaagcctaatacccactgcacgattttcacggcaatacccataatggctgataagacaagcatcaaaacagttcgtttaactagtatcttatacgaatagcctgcatggcgcttaatcatgataaacccatataaaagggaagcgatatatccaagcgccgtcgctaaaatcgctccgtcagcctgcatcagcttgatcagcggaacattcagcacaagcttgatcacgacgccgatcacaaggctgacaaccgcaaatttttgcttattgatgccctgcagaatggctgcgttgactgtaaacaaagagaacagaattgcgactggcgaataccatagcaaaatgtttgcccccagttcagggtgaaggctctctgacccgtaaaagaacgtatacgtcggtcctgacaatagagagatcccaacaacagccggaataattaaaaacaggatcgtctgcatcgtttgattaatctgctgatttaacagcttatagtttccgcttgtaaacgattcagtaatcgttggaattaatgtcagtccgaaagcagttgctagggaaaccgggatcatcacgagcttctgaacatacagggttagaatcgcaagcatgtcttggctgatggcttgatgaccggcttcaatcatcgctttgttaaacgtatttgtatcaatatagttatacaaagggatagctagtccaacaaaaacgtacggagcagcatagctgaacagctcgaaaaacattttcttgtagcttaggtttgctgtcggacccgtattcggcatcatcgccagcaggctgcccttccgtttgttccaataaatataaagcacgaccagccctccgaaggcaccgatcagcgctgcgaaggttgcatagccgacagcgatgacaaggccgccgttgaaaaccttcaaaatcaagaatgtcgcactcaatagaaagatgatgcggacaatctgttcaacgacttgggaaacagctgtcggacccatcatttggtgcccttgaaagaatccgcggacaaggctcataatcggtacgaccaatagcgctaagcttaccatgcggatgacataaacgacatgatcaattgtcaggccgttattatccttgcctcccagcgatatttccgcaaacatcggagccgatagatacagaatgaaaaaggctatcattcctgtgacgagcataaccgacatgcccgccttgagcattttcctgcttgtctcataatccccttttgaattatatttggaaacaaatttagaaacagcggccggaaagcccatcgtagcaatattcaaaaataaagtgtattggttgtatccgtattgaaataatgcaccgcctgtcgccccgaccataatgctgaagggaattaaatagaccatccccagaatccgcgatatatatgtaccgagcgttaatacaaacgtgcctcttaacagtttgcttgacatgtttcttcatcaccattttctacgaagattcaacttttctattttaccacaactgggcatttagacggtaataaatacaaaagcaatcctgtgaacattcatgtccgcggcaaaagacgtttaaggagcggctttctttcgctataatagtactgcggacggggtgtccgcacacgaaatgaaaagaaagttgatgataaagatgaaacaatatgacgtaattgtaatcggcggaggcccttcaggcttgatggctgcgattgcagcaggagaacagggcgctggcgtgttgctgatagataaaggaaataaattaggacggaaactcgcgatttccgggggcggccgctgtaatgtgacgaaccgccttcctgtggaagaaattatcaagcacatccccggcaacgggcgttttttatacagcgcgttttctgaatttaataatgaagacattatcaagttttttgaaaacctcggcattcaattgaaggaagaggatcacggccggatgttccctgtgaccgacaaagcccaaagtgtcgtagacgcgctgttaaacaggctgaagcagctccgcgtaacaatcagaacgaacgagaaaattaaatctgttttatatgaagatggacaggcagcagggattgtgacgaataatggcgaaatgatccatagccaggcagtcattatcgctgtcggcggtaaaagcgtgcctcataccggaagcacgggagacggctatgaatgggctgaagccgcgggccataccataacagagctgtttccgacagaggttcccgtcacttctggcgaaccgttcattaagcaaaaaacactccagggcttatcactaagagatgtagccgttagtgtgttaaataaaaaaggcaaaccgattatcacacataaaatggacatgctgtttacccatttcggcctctcaggacctgccattctcagatgcagccaatttgtcgtaaaagagctgaaaaaacagcctcaagtgccgatcagaatcgacttgtatccggatatcaatgaagaaacgcttttccaaaagatgtataaagaactgaaggaagcaccgaaaaaaaccattaaaaacgtgctgaagccttggatgcaggagcgctatctcctattcctgctcgaaaaaaacggcatctctccgaacgtatcgttttctgagctgccgaaggatcctttcagacaatttgtaagggactgcaagcagtttactgtcctcgcaaatggcacactgtcgcttgataaggcatttgtcacgggaggcggggtatctgtaaaagaaattgacccgaaaaaaatggcttctaaaaaaatggaggggctttatttttgcggtgaaattctggatatccacggctacacaggcggatacaacattacctccgcccttgtcacaggcaggcttgcagggctaaatgccgggcaatacgcccgttcttaatcattactctttaaatctcttgccgccaaactcacatttgaacattccccgcattcatgttagggtgagacttgttttgtttcacctgattgcggggtaattttaagagaggaatgagctgccatcgtacgaccatactaagcctgcgagcaagatataggcgtacacaaaaaattagagggtgagaaatgttgaaacatatatctagtgtattttggattgtgattgcaatcacagctgcagctgtattatggggtgttatttctcctgacagcctgcaaaatgtgtctcaatcggcacaagcatttattaccgattcatttggttggtattatcttttagttgtctctttgtttgtcgggttttgtctctttttgattttcagcccgatcggaaaaatcaaactcggaaagcctgatgaaaaaccggaattcgggttattatcatggtttgccatgctgttcagcgcaggcatgggaatcggcttagtattctacggtgcggctgaaccgatcagccattacgcaattagctctccatcaggtgaaacagaaaccccccaagccttcagagatgcactccgctatacgtttttccactggggtttgcacgcttgggccatttatgccattgtggcattatgcattgcctatttccaattccgcaaaggcgcacccgggttaatcagcagcacactgtcaccgattctcggggataaagtaaacggaccgatcggaaaggccattgactgtattgcagttttcgccactgttgtcggggtgtcaacaagtcttggtcttggcgcaacccaaattaacggcggtttgaattacctgttcggcattccgaatgcgtttatcgtccaattggttttaatcattattgtgacagtgctctttttactttctgcgtggagcggactcggaaaaggaattaagtatttaagcaacacaaacatggtattggccggattgttaatgttgtttatgctcgttgtcgggcctacagtgctgatcatgaactcatttacagattctatcggacaatacattcaaaatatcgttcaaatgagcttcagactgacaccgaacgatcctgaaaaacgcgaatggattaacagctggacgattttctattgggcatggtggatttcctggtctccatttgtcggcattttcatcgcccgtgtatccagaggccggacgatccgagaatttttaattggcgtcttggtgacaccttgtattttgacatttctatggttctccattttcggcgtatcagccatggatctccagcaaaaaggcacgttcaatgtagcaaagctgtccactgaaacgatgctgttcggaacacttgatcactatccgctgacaatggtgacatcgatccttgcattgattctgatcgcagtattctttatcacgtctgctgattcagctacattcgtgctgggcatgcagacgtcgtacggttctttaaatccggcgaattctgtgaaactcagctggggtatcattcagtccgccatggcggctgtgctcctatattccggagggcttgccgctttgcagaacacagcgattctggcagcgctgccgttttctatcgttatcctgctgatgattgcctctctctatcaatcgctctcaaaagaaagaagagagatcaaaaaagcggagaaactcgataaaccgagaagtcctagagtgaaaaaagcatattaacaaaaaagatctttccgcgcctgcggaaagatctttttatttgcgatataaaataagggcggaaaaacagtaaagctgctcgccgtctgggtcgcacgcggccgaaaccgtatatttgatatcaatcagctgctcctccgatatcccttttaaaaatgaattgatttccgtctgtaagtctttttcatgctcttcatcaaataccgctaccttcagcattttatccgctctcctttctctatcaatctattccgtttggaacagcgttatgatagagaaatgatgattatctcgtttccggataaaaagctttccgtatatgggattccctctgtggctcgccgccttgctgctccactttcagcagcacggcataaacaatgcgcatatgacagtagctgataaggctgacgctgaaaaaagggacaatgcccggcaggtacgcaagcaagaaaaaaagagcaacagtcagcgcaagcatagcaagcgtatattgcaaatacgccacactgagcaagagcgaaaatttcacatacagacgttttttccagtcaaaatggacaagcagcggaaacacataaaaaagcatggatacgaacaaaaagccaaatatcataatggcgaagcgcaggatgtgcagaaggaaatgacttggataaatgaaggccaaatcaatataaatgatcactccgatgagcgccagtacagcgccgagcagatttgaacgaaaaaattcacccttatattcctgccaaaacgttttgagcacgggaacgttgtcctgcccctgaatccacttccgcatgacagcgaataaagccgcggtcgcgggcatgatgccaaacacaccgagaccgagcaacgtaaaaaacagccacagcaagtttgtatacgcaaatctcatgatccattcgcaaaaacgcagcatccgtcccagtgagccatcatgttccatggcgccccctcctttttttgcattatacattctgcatctgaaaaagctctttcatgccgatcggcttcttttcggcaaccgagcgccacattccctcaccaaccgcgatggagtaggctccagcttcagccccggctaaaatatcatagcggcgcagcgggtcttttcctaaaaaaagatcctcaagcaaaagcggatcacctccgccatgccccccttcatttttgaccacttgtatcgtctgctttgattcaaaaagcggatagtattcgattgtctgctcaggaaaagcaaacggaattctggaaggttcgtgaaattcatttgattcaatacgcccttttgtgccgttgatcgtcagccggtagccttcatacggtgccgaaaaaataatcgagtagcttaacagtgcgccgccatcatatttgactgccgccacgtacgtatcctcgatgtcaatttcctcgtcaaaaatacacgcgtcaggcctgtatgcagtatataagctagactggtctcctgcttcgagatgatcatcttttatagaagctttagaggaacggggatgccaccttgaatagtagtggcatttttctttaacacggcacgtcccgcaaaaacgcccgtcttcttccggcaaggggttccactcactgtccggcccatagtaattcaaggcgccataagcaaatacctcttccggattttgcccgagccaccaattgacgagatcaaagtgatgtgttgatttatggacagaaaggcccccggaaaactgtctcgacctgttccagcgtttaaaatagctggcgccatgatacgtatcaatataccaatttaaatcaacggaggtgaccctgcctatttttccgtccagaatcatttcttttattttccgatgaaacgggctgtagcgatagttaaacgcgacggtgacttttccttcgcttttggcctccgcttcaagcacccgattcgcatcctgcactgttgtcaccattggtttttcagtaattacatctgtatcccactgaaggctttttacaatatatgtgacatgcgtatcgtccctgcctgccacaatgacgatatcaggctttgagacgcgcatcatctcgtcaaaagcatcttcgctaaactcaggcacgtgggccagctcgggaaatttctttttgcaaacggcaaaacgtttcggatcggcatccagcaatcccgtaatctcataatgagttgaaaaccgctccaacagcggtttgataaacatactgaatgctctgctgctcaatccgcaaaagacgatgttcttcaatatcctcacctctatcgggcttcagttagttgagaaatcagctgcagcgcttcctctgttttttcagcatacacagggataaacgccgccatatcgcgattcaatcgaaaagaatagccgttcagctgttttttccctttttcgatctgaacggcatagatcgttttttctcctgttttattattaacagttgtataaggagatgttttttcaggaggcaatccgtttaacggctgaaaattttccggatcattgtaagcttgaaacatgtcttcaggcacgatgaaaacatctccctcatgggcggtaatttcagtcagcagtttttcctgaaaagctggaaagatatcgaccttcccagcattctgctcggcggccttttttattttttcctgtacgccagcctgcatatcagaaaagagaatgacatgcattccgtccgtcctgcttgagcatgatgccaaaaagagcactgagacgatcacacacaaagccgtacgtatcctttttgtcatttccccgctgacctaaaaagaggctccagctctgtcatagctaaaataaacgcgccggctccgtgcagatcgtttttgcttctttcgcggctgacataatagtcatagaaaccggctgacgttccgacacatatgtctttgacgagaaacgcgccgtcttctgatgtttcggttttatgctgaatcaagccttgatacgcttttagcagtgttgtttcgtaagctctgtctaaatagcctttattgattcccttcgcaaatgcgtacatgtacaggcaggatcctgagctttccagccagttatcagacctgtctcccttatcaacgatctgataccataaccccgtctctttgtcttgatagcggcagatgctttccatcatgtcctgcagcgtgtttttccacccatgacggtttggatgcttcttcggcagctcttcaatcatgtcagcaagagacatgacgtaccagccgatggaacgtgcccaaaattccggtgaacagcctgtctcttcattggcccaaggcatttttttcgcttcatcccaggcgtgataaaagagtccgttttttgcatccttcgtatgctttctcatcaatgactcctgcagcacgacctgatcaaacagctccggctcctgcttcagattggcatatttcagtgcgaacggccccccatgtataagccgtcaagccacatttggtatggataaccgtctttgtgccaaaaaccgccctcagacgtccggttcagtgttccatataaaccgcgcagcctttttgccgctttggcataccgttcatccttcgtctgctcgtataatggaaaaagaatgagacccgcttgaatggcgtccagttcatctcttctaaataatagattgccataatcatcgattaagagatctgcataggccttcgcatactcaaaataccgcttttccccggttgcttcccacagccgcaatacaccgcataagaaaacaccctggtggtagtgccagcggtttgcaggaggcagctcctggactgtgtacgtattcataatggtttttgccaatgcctccgcgtacgtaagaggcgattttacagcgattgattgatccattgatcccatccctttcttaataaattccttcctcgccaaatttcttcgctaaacgattcgcaagcatgaccaaaatcagcccgaccgccgctttaaatacgccgactgctgtactgtagctgaattgtccctgtttcagccctgcagtataaacgtacgtatcaaaaatttccgccacttccctgtttgtcgcatttaacagcaaatacacatgctcgaagccaagctccagcgtgtctccgattttcaaaatcagcaaaacgacgataacgcttttaatggcgggcagcgtaatatgccacatttgccgcagccgtcccgctccgtccattttcgccgcttcatacagctgggggtcaaccgctgtaatggccgccagataaatgatcgtcgaccagcccgcttccctccagataacctgaagaatatacaggggccggaaccattcttcgttcagcagaaaattgattttttcaccgccaaaaaacacaatcagttcattaatcaagcctccgtctaccgttaaaagcacaaacgaaagcgatacaacaatgacccaagacataaaatgcgggatataaatcagcgtctgaacaaattttttaaagagagcaatccgcacttcgttcaatagaagcgccagcagtatcggcaccgggaaaaatatggccaggttcaaagcaaataacacgagcgtgttttttaacaagagaaaaaatgtaggctcagtaaacagcctgataaaatgcttcagccccacccactcactgcccaaaatgccgaggaacggctgataatcctgaaacgcaatcacaattccccacatcgggacatacttaaaaagcaaaaaataaatacaccccggcaaaatcatcaagtacaaatatttttgctgaatcagcttgattagtaagcgctttcttttttcttttttaaaaatgactgtatcaacagccggcgcttgcgcttctgctgttttcattttttcccatcctcctttcacgggttcttgcattcactgtagcgcagaggtaaaagtccgtctacaatcatatgatcacatcctgttttatccctttataatcaaaggttcaggaggtccacctgaaaaaaagacaccgatattagaaaatgattattgacaatatctatcaatctttggattaattgtattaaggtgaagtggatgttatgaaatggggggttttatgaaaagaagccaatacaagttttactacaaactgattacgtttttctgcctgctcagcaccattccggttattttggtcggattgttttcgtacgagcactctcagaaaacggctatatccaacgtttcagaggaaaaattcgacacactccagcagacccagcaaagcatcgagcatatattgaaaaccgtcgatcactctttaacccactatgtgagttcgccgcctctccttcgcacattgtccgagcctttgcactcagaccaatttcaaatctataaccaagtgaaccaagagctcaattatctgcaaagctttgataccgatctgtccaacatgacgttagtcagttatacgaaaaaatggtacatgaacaattccggtttgtaccgtttgaatacagacactcttcatgaagcagcctcagcgtacacgaaacaaaaagcgagccgctcctattggacgcttgaggaaaacaatcatttgatttcaaccaaagaaggcacagcagaaaactgccgctacaatatcaatttaattaagcagcttcctttgaacagcacaaatacaaagggattggccgccgcaagcatcccgagctgttcgcttgtcaaaaatatgcccggctattcaaacgccaacaacctgtttatcatcgatgaaaaaggcctcatcatccttcataacaatatgtctgacgttggtgaatctcttcataacgacggctttgtccaaaaagtgctggcgcaaacggccaatagcggacagtttgaaacagttattgaccggattcattataaagtcacctatcaaaaatctgactataatgcatggacttatttttctctcgtttccctgcctgagttaaaaaaagaagccaaatcaatcggctggatcacttttgcagtatgcctcattttgttaacgctttcattgctgttctcttggcttggctcccgccatttttacaagccgatcagggtgctttacgaatcattcgcaaggcatggtgccatacaagaaaaacagccgcctcaaaatgaatttgagttaattgaacagagctttaagcagctgaaggacagaaatgatgatcttgaagaaacgatgaagcagcaagccacccacctgcagcaatattttatggtcaggcttatgctcggaaaactgacggatgaggaggttaataaccgttttgaaagcctcggtttaaagcaaaattggcggcaccttgccctgcttgtgctccaaattgacacactgaatcatacgccttatgagaaaaaagatatggatctgcttttgtttgccgtcaacagcctgattgagcgcaacatcccgacggacaaacatcttgcccccgccgtagttgacaaacagcaggcgacgattttgatcaatcaaagcgggacaaaggaagaattcatggctgagctgaatgagactgcaaggatgattcaggaaaaagcggaagctgagctgcagctgtctgtcagcatcggcatcagccagccgtttgatgtgctgacaaaagcgaaaacagcctatgcggaaggctcagaagcgttgaaatatcggctgaaagcggaaaacaagtcgatcatcttttacgaagaccttgaccagaaaaaaaccttcaaaacccattttccaaagcagcttcagcatgagctgttcgatgctgtcaaagcaggagacaaggagaaagcggataaatgcctgcacgcgattttacaagccattttcacccagaacaccaacccgtatcaatttcaaatcgccatcgcccgttttttgaaccatgtgattgagctgatgcatgtgcttgggatcgaattgtttgagcttgaagaaaacaaaatgctgtatgaccaaatttttgagctgaaaacgttcgaggataccgaaaactggctaaagaatgagtttattgatccgatgacagacaaagtgaacgcccgcgcggatgcccagtacaaaaatatttccgacaacatcattcatatcatccatcatgagtttgaatccgaattgacactggacgaaatcgcacgcaggctgcattacaacccaaattatttaagcagtattttcaaaaaagaaatgggaatttcattcagcgagtatgtctcaagctaccgacaccatatggcgaaaagctggcttgccgaaaccgacatggcggtcaaggacattgccgaaaagctgaaatataaaaactcgcaaaacttcatcagatcatttaagaagctggaagggattacaccgggaaactaccgccagcaaaaaagaagcatgtaaaaaacccaaaaccgcttgcgcgttttgggtttttccaatgttattttgcttgtttaaacgcttcttcgtattcctgaataatttgttttcctccgcttgactcccatttttccacttctttatcgaactggctttctgtgatgtctccaatcatatatttgtaggtcgcgtcatcaatgattttcttcagttcgtcaccccgttccgactccgatgcggaatacaggctttcagccgggtttgagacgataatcttttcattgtcctcggtcagctcctcgtacgccgtccgaagcggatctccagtgttttttaagtaggctttatcaatggcaattaaagcggacagcggctgaatatcagtctgccagtcttttacctggctttctttgcgtgtaaacgttttgtcctcacctttgttgtaatgaacgccgtcaatgccataagtcatcaggctatagacatcttcttcggcaattcggtcaaaaaacgccaagatccgtttaagctcagcttccgttttcacactcgttttcgggaaagcaaacacgccgttatggcctcctgatgcccatacccgctctttcccatctgggccttttatgcggttgatgatctcgagcttcatcgatttatcagaggcatggtcgcgcagattgaccgcatctaccatattgccaatataaattccggcttttccttgagaaaacagctcctgctgctgggttttgcttgtgacgggaaaatccttattcatatacccgttatcacgcagctttttcatatagttcatcgtgtctttgtattcctgtgtcatgaaatcaggcgtgaatttgccgcccgattccttccaatctgtcggcatgccttcatacgagccaatcgttttaaacgcgccgtaaatcaagtcattacggtctgccagcccgatcgtatcatctttcccatccttgtccgggtcgtcctccgtaaatgctttggccacttcataaagctcatccaacgttttcggggttttcaaatttaaattgtccagccagtccttccgaatgacgatcccctgtctggaaagcgggcgctctctgtatatcccgtagagctttccgtcaattgtcacatttttattaatgagtttgttcattttgtttaagttgggataatccttgatataatcgccgatttcccaaaacattcctgaccgaaaggcattcatgactgacgaatttttaatatcctggatggtcacgatttgcggaagattcccggctgcaagcgctgcattcagcctgtcttctttcaccgcgtctggaacccaggtgatgtcgagttctgtatttgtcagcttttcaatttctttaatcgccctgtccttcggcggctgctgatgatacaaaatcgccatccaagacagctttatctttgaatctgggccagctttgccttcagccgaagactgatcagttcctttacagcccgccagcactccgccgagtgccagtacaagcacaatcaaaagcaccctccatttgtttcccatcgtacccctccgtttcatatttctttatcctttgacagatcccagcaaagctccttttgcaaaatgcttttgtataaacggatagacaagcagaaccgggatggtcgccaccactatgaccgccattttaatggtttgctcaggcggcgggctgcccgaccccatttcagacatatccccctgcataccgcttgatacaatgacgatttggcgcagaagaacctgaattggccattttgctgaatcatttaagtacaagatcgctgtcatatacgtgttccaatacgtgaccgcataaaatagtgaaatcgttgcgatcgcaggaagagacagcggcagcacaattttaaagaatatgcccagatcattgcacccgtcaattttcgcggactcttccaggcttgatgggatattttgaaagaagtttttcagaatgatcaggttaaaggcattaatggctgtcggcaaaataagcgcccagtaagaatcgagcaatccaagcgatttgaccacaaggaaagtcggaatcatgccgccgctaaacagcatcgtaaatacgacgagaaacatgagcggctgccggccgattaaatcatggcgggataacccgtaagccatcagtgaagaaagaaacatgctgaccgcagtgcctatcactgtcacaaacacagaaacaagcaaactcttataaataatatctgttgaaaaaatgtagcgataagcatctagcgaaaaagtggtcggtattaaaataaattttttcgacacgacttcttctactgtggcgaaggatgctgcgatgacatgaatgaacggaagtacgcatattaaagcgaacatcagcaagaaaccataaatcaacatatcaaacagacggtttttcagtgaatgtgcgatagctcccacctctctttgtaagcgttatcatatttcggaaaccgagctcagcatgtgacgatatcgtgtctaaaatgtagcaaatctgtgattgccatgtctataatcatttgaacagtgtccccggccgggcgggggctgccgcgaattgagaccgataacaaaagaaaaagagcataatcttagaaaatgattatgctccgttctcctcctcgttcagaagttcagccgtattgatttgtggcgaaaacccaagttcattcacggcagattcaatggaccatggccggcccggattatcagagacggcgtaataagtgccgtaccggatattggtctcaatagcggctttgaaaatcgacagcagatcggggtgagaaagcagtgtctttttcgtccgttctttttcatgcagcgtatccatttcatctgtgacgactgttccgattcgcaggttgattactgatagcttattttccaaataaaacaaatggccgatctgttcagaggtcagctttaatacaccgtacaagttttttgacagcggataatcgcttgttgtgatttcccgtcctaagagcgagcgcccgtctttttcgtagacatctgtgacatgattactgctggcgaacacgagcttttgaatgccgagctccgctgccgcacggcacagataatagcttgccctatagaaaacatccgtcattttttcaaactcagcgatgtccataatatcgtatttgattttcacagcgagtaaattcaagatgacatccgtatcttttggaatcttcttcaacagctcctcataatttgccgcgtcagcctgaatggaagaggctttgccatcgaaatgatctttatcaagcacagtcacttcatagtctgaaataagcccttcagcaagcagtctcccaatcacaccatttccgccggcgatcagcacttttttcactatgttcactccccttttttatagattgcccattttcggcggggctgacacttttttggcactcacattcttaggcttattcaaaagtcaccggcagctcctcaagcgcccgaaatccaaaaagcggccgataccgccattcaaaatccgcgagattaaggctgggcattcgctgcagaagagtgttaatcgcaatttgcgcttctaatcgtgccagcgaggaccctaagcaaacatgatggccatgcccgaatgaaagatgcggattaggacttctcgtaatatcgaagacatcggggttcgtgaatatgctagggtctcgattagccgcccctaacaaaagatagacttgttctccttgacggatcgtcaccccgctgatgtcaatatcctctgacgcaactctggctgtcatttgcgtggggctttcatagcgtaaacattcctcgactgcggtatcaataagatctggattttctctcagtttcaaaagctgttctggatgctgcagcagacaaaggactgaattgctgatgagattgaccgttgtctcatgtccggcgatcgccagcaatatgcacgtagatgccgcttcctcttccgtcagcttatccttttctttccccttcaagagcatgctgatcatatcctgttgagggtggcgttttctcttttgaatcagctctttgaaatatgccatagcctgcacagccataatattgccctctgttaatgcctttcttgagcgggtaaaatcaatcgtttgaatgagactcgcagcccactcctttaattgctccctatcttcctccggtacacctataatgttagctatgacaaaacttgctaaaggaaaagcaaagtccgaaatgacctccatcttttttttaccttgcacttgatcaagcaaatgatggacagtttcaatgatatacggctgataactctctgtcgttctcggcgtaaacgctccgctggcaagcgtccgcaatcgtctatgatcaggccggttctgaaacagcatcatttgattttgcacatgtgaaaggtcctgatatttggttgagctctcaggcagcggggtgcggactttgaatctcgcatctttcaaaatagcagccgtttcttcatatcctgtgacataccagcccgggtattttaagaaactccctttatagataggatgaacagctcgcaatgtgtcgtaaaaagaatatgggtttttcaaaaactcagaagatgcagttgacgatgcaattgtcacgtgattttctcctttctgttcaaaaataaaagcaatcgacatcataccgattgcttttattgattctttcagcttttcgcacttaaactggccttcatttcttcgactgattcaacttcaaagcctaaatcactcagcattttatgatcctccgtctcctcttgcccggcagttgttaagtagtctccgacaaaaatggagtttgcggcgtaaagccctaatggctgcaatgagcggagattgacctctcttcctccggaaatgcgaatttcttttgatggattgataaaacggaacagcgccagcacttttaaacaatacagcgggtttaattcgttgacgccttctaacggcgtgccatcaattgcatgcaaaaaattcaccggaatggaatccgcgtcaagagccttcaagcttttggcgatgtcaatgacatcctgtttcgtctccttcatcccgataatggcgcctgaacacggagacagccccgattcttttgcgatttcaaccgtattgactctgtcatcgtatgtatgtgaggtcgtgatgtttgaatggtttctctgtgacgtattcaaattatgattatagcggtctactccggcatctttgagacgcttcgcctgctctggcttcaacagtccgagacacgcacaaaccttcagtccatacgtctctttaatttcctgaaccgcatctacgacctgatccacttctctgttagacggccctctgccgcttgccacgatacaatatgtgccgatattcagatcgtgcgcccgcttcgcgccttcaagcagcgtttccttattcaccatccggtaagactcaatcggcgctttcgaaatcgcagactgtgaacaatagccgcagttttccgggcagagcccggatttcgcattcataatcatattgagctttactttttttccataaaagtgttttctgatatgaaaagctccatgcattaatagcaaaatatcttcatcaggacaatgtaatattgaaagcgcctcttcgtcagtcacttctgctccagccagcacccggtctgcgagttccatccattgattcattctcatacccccacttgattcatcagtaatgatagattgatatggtcttttaccatatgtagaaccgtttctttcgtcacgttggcaagctttggcgtaacccctaaaatcggcacaccgcataagcgctcaatcatctcaggattggttttttcatcttcatcaggagagtcactgattccattgatgataattccggcaattggaagccccatgctttctgcatatttgacagttaaaaaggtatgattaatggttccaaggtgaggacgtgccacaataatcatgggaagctgcaacgcttttatgacatgactgaccaaatagtcctctcccaatggcacagaaataccgcctgcaccttctacgatgaagcattcatgtttttctctaatccgcccccaatggcttaaaacctcttccatggtgacagtctttccctcaagtttccctgcaacgtatggtgcaagcggcgctttgaaggcaaaaggcgtaatgtcttcatgagaaagactggtctgcgacatgtctttcagcaaacttgtatcactatctggatgatgacgcgatatcccgcttaaaaatggtttatacacaccgacatctctattatgttctttcaataaggcagcaagaccgctggatataaccgttttccccacttctgtatcagttcccgtcacaaaaaaacccctcaaatgatatgcagctcctttccgattgaatgaaatgttttcagcaaatcatcaatatcacccatactgtggtcagacgtgattgtaattcgaatacggctttcacccggtgcaacggtcggcggccgaatggcaggagcataaattcccttgccctgcagtttttcagcaaataggaccgttttatgggcatcgccaatgactacaggaataatcggtgtgtgatctcctttcaccacataacccatattcttcagactggttctgatcgtactgatataagaaaataaaagctgtcgtttttccctgctggcttcaatgatgttgaaagcctcatgagcagccgcacagctggctggcggaatagcggtttgaaagataaatgttctggcatggttcagcaaaaagtcgatgaagaccgctgatcctgccgcaaaacctccttccgcgccaacagctttgcttaaggtgccgatcacaatgtcgggacaaacaccaaagtattcactcgttcctcctcccgaatcgcccaaaactcctgttgcgtgggcatcatcaacgaccacgaaggcatgatagcgtttcgcaagtgagatgatctgatcaagaggggcgattgtgccatccatgctgaataccccgtctgttacgataaaacggcgctgataacgctgtgtttcattcagcttgttttcaagatcattcatatcaatatgccgataaacaactgtatcagccttagaaagtcggcagccgtcgataatacttgcatgattgagctcgtcacttaaaatgacatcttccttttctggcaaggatgaaaggagaccgacattggccaagtaaccgctcgaaaacagcagggccgcttctgtccgtttaaagctggcaatcttcttttctaacttttcatgccagaccgaattgcctgtcgttaaacgtgaaccgctgcttcctgtcccaaattgctgcaatgctgtttgggctgcatcgatcaaacgtctatcgcttgcgagccctaaataattgtttgaggaccagaccgtttgattttcgccatcaatgttccgctctggaaccggcgctccatccattgaccgcaggttacggtgtacgccggcttcctttactatgtctaaccgctcgtttaaccaggaatcaatcttcaaggctcgtaacctcgtggatcgcttgtttcataatggcaaccatttccgagagctcttcagctgtgctggcaagaggaggaagaaatgcaatcacgtccccaagcggccttgtcagcattcctaactctctcatttttaaggaaactttgtatccaatccgccgatcagccgggtaaggttctttggtttcctttgatcgtacaagctctgcaccgcacataaagccaagctgccgaatatccccaacataaggaagagcgtgcagatcttgaagaagaaaatggagctttttactttttttcgctacttgttccacaatgttttcagattcaaataatgccagattttcaagcgcaactgcacagccaagctgattgcctgtataggaatggccatggaaaaaggtttttaggttttcataatcatcatagaatgccttatagatgtcttcagtggcaaacgtaacggcaattggcaaatagcctcctgtaatgcctttaccggcagccatcagatcaggctggacattctcgtgctcgcacgcaaacatttttcctgtacggccaaagcctgtagcgacttcatcaacgatcattaagacatcgtatgttgtacatagctcgcgcacgcctgccaaatatccttccggcatcacgatcataccggaagccccttgtaccattgattcaatggaaagcgcggcaatttcctcgtgatgttccttaagcagctgttcaagctctcggaggcactgatcacggcactcatcaggatcaccgctttcagagcgatacacataaggaatcggggccttgtaactctcgaacatcaacgggccgtatacgtggtgaaaaagctcaattgaaccgacactgacggcgccaatcgtatcaccgtgatacccgtttttcattgcgataaatttttgtttctcgggcttcccgatgttcttccaatactgaaacgccatttttagggctatttccatcgcttctgcaccgctgtctgaataaaagacccgcgtgagcttttttgggctgatatcgattaatgtttcggcaagctgggttgctggaacgttggtcatgcccaataacgtggagtgcgcaatttttccgagctgtttttttatggcattatctagttcttttttgcggtgtccgtggacattaagccaaactgatgaaaaaccgtcatagtattccttgccatttatgtctttgactttgattccagtcccgctttcgatgattaaggggttttcatcataatctttcatttgggtaaatggcagccagaggtgctttttacttttttctatcaaatcatgagtcatgatcttcctcccactctattaaaataggctgcttctccagatcatgtatgtacgtgtttacatcattggatccatcaataaaaaagactcggcagccctcttcagtcccgtattctttcattgctgtaatacgctgatagcccattttcttacccgcaacatagcctgttatgtaatccggatcgtccgaccagcataattctgcaacggctgccgggtgccggcttacctttgaagcgagcgcaagggcctcttttattcttgaatgagccggcacgtgactgtgaagcgcccatttttcaaaattagcgtccggccaatccattctggagacccgcacccctttttcttttgtttgatccattcgctttcctgtatgaatatcaaacaacaccgcacccctgatatctgaccattcagggatttgttcatatgctttttcaatcacgtctcgtgaaacgccttctttttccaataacaatcgggccagcttttgcccttcttccgggcagctcacttcattcgtatgcacaggcaatggctgaatggtttttatcgattcatatacctcttcaaattgaatttgcataaaatcaggttttcctcttgaatgggataaccctttttctaataaagcattgactgtatgcttcatctcatggaaaggtataagccgttctccgccggatatatgctttccgccgtcttcatgagatccattcatagaagccctcattctgacactataaaaagtttcttcttgcatcatttctcgccctttcactgataactgaagaacgtgtagtgcttctcaccttaattgttaaccaattatattttaaggttaacaattagaatatattattctctcctgtttctgtcaatagaagaaagcatcgatttatggcagttggttaaaaggaaacaaaaagaccgttttcacataaaacggtctttttcgatttcttttaacagtcacagccacttttgcaaaaaccggacagcttcatgcctcataactgctgtttcgaaatgtcccgaagcagaacggaccactcggtagcaatcagaagctccctgtccagcatagacagctgtcaattctttttcgattttgtccacgccctcggccggcgttaaccgatcgtgtacaccaacaagactaaggtgcgggcgcggcgcgatcaggccttggatctccgatgcggaaaaatgctttgcaagcgatgggacgtaataataaaagccgtgcctgtcaagattctgtgttttgatcagcacgtgatgatccacctggctgcacaaatccacacacaccttaatccggtcatcgagcgccgctgtccaccacgccatcaaacctcccatagacatgccgatggttccgatcctgtcaggctgaacatcagagcgtaactgcatatagtccaacgcacttaaactgtcataaatcatcatcccccacatcacttttccggtgagaagcatttctttaaatatctcgctttccgcttttccccgccgatctccaaatccccaatgatcaatcgcaagaacgccgtatccgagtgaagtaagctcatcagaaaaagaaggcgttttcaaataatccgctccctcaatcagctcactttttcccctatcatactggcccccatgcgaatgctgaaacaatacggctgggcacggtccttctgttttcttcggcttcacaaaataagcgggcaccttttcatgtccatttaaatcgagcaggagcgtttcaacgatattttcttctctttcttcaatacgtaatgtctcaacactgattggcctccgatcaggcaaatcaccaagcaatcgaaacagttgctttcttctttcggctctcatcccatcacccttccttattcgcttacttcacatttacgagacagatctgggttcccctttatttttccaacataaatcacatcatttactaaatatttagtaaatattatgaaatatttcgaaaacaattattgtaaccgcttacttttatatgatagtatcaatttatcaaaaacagatgagttaatattttactaaatagatgagagggatacccatggttcgtattaaagatatcgccttgaaagctaaagtttccagcgcaactgtgtccagaattttaaatgaagatgagtcgctttctgttgcgggcgaaacgagacaaagagtcatcaacatcgctgaagagcttggttatcaaaccgttgccaaacgccgaaaagcccgcgggcaaaaacagcgggctcagccgctgatcggtgtgctgagctgtctgtcccctgatcaggaaaggcaggacccttatttttcttccattcggaaagggattgaaaaggaatgctttgaacaggaaattttcattacaaattcgattcatctcggctcctttcaggaacatatctttcgggaattggatggtgtcattgtcatcggccgtgttcatgatgaagcggttaagcatatcagcgggaggctggagcatgccgtatttatcaatcattcaccagatccgcaagcatacgattcgattggaatcgattttgaatcggcttcacgccaggcgattgatcaccttttcgacttaggctacaaacggttaggctacattggcggacaagaaaaagagcatacgctgaaggacggccaaagcattcgcagaacgattgaagataaacgcctgaccgcttttttggagtcagccgccccccagcctgagcatgtgctgatcggagaatacagcatgcgtgagggctatcgcctgatgaagaaagcaatcgatcaaggccatctgccggaagcattctttattgccagtgattctatggcgatcggcgcattaaaagcgctgcaggaagccggactgcaagtgccgcgggatactgcaatcgtcagctttaacggcattgaggaagctgaatttgccagcacgcctttaacaacggtgaaggtatacacagaggaaatgggccggacaggcgtaaaactgctgcttgaccgtctcaatggccgaacacttcctcaccatgtcaccctgcccacaacattaattgtaagacaaagctgcggatgtacagcaaaggaggtgacataagcaaagattcatcacgatgataaggaggaaaagatgaaacacacttttgttttatttctctcttttattctgcttgttctgcccgggtgttcagcagagaaaagctcagcagataccgcaaaaaagacgttaaccatttattctacaatgtcaaccgacagtgaaagagatacgttcagaaaactagcggcagcattcgaaaaggaaaacagtgacattcatgtcagccttcatttcccaggcaatgactatgaaaatatgatgcgtgtcagaatggcggccaatgatttgccagatctattcgatacacatggctgggggaaaatcaggtacggagaatatacagcggatctccgggatatgaaatggactcaagatcttgatccaaatttaaacagcatcctcaaaaataaaagcggaaaggtgtatgcctatccaatcaatcaggcaaaagacggtctggcgtataatcgcaatattttagaccgttacggcattgctccgccggaaaccatggatgactttatcaaagcactgagaacgattaaagaaaagagcaagggaagcattgttcccttctggtttgccggatatgacaaaagctcattcgcccaatattacgaccaattcgctacacctcttctcatcacagaccctgcccataatgaaaaaaaacagctcaccaatggcactttcaaatggaataaatttacttacttatcgaaaatcctcaaacaaatgcagaaagaaaaattgattaacatcgacgccgtcacggcaaaaaaatcacagctcattgaattaatggcccaaaacaaaatcgcctttacaatgcaaggcggcacactcggccaagacgttgcccagatcaatccgaacgtcaaggtcggcattatcccgacacctgccatccatcccggtgatgacccgatatggatcggcggtgaacgctacacccttgcagcatggaaagattcgcctcaattaaaagaggcaaaagattttatcgcatttatggcccgcccggccaatgccaaacaaatggctgaagccacatcgcttccttcagggctgaccaatgtgaaagctgatattttctacgcaaacgattatgagcattatcaagatgtcaaagtcgagccttacttcgaccgtttatacttgccaaacggaatgtgggatgtcctaggcacggttgggcaggagctcgcggctgacattttggcgcctcaagacatttcgcagaagctgggaagagaatataaacgactccgggagcaatcggaaatacagggagctgaaaacaatgagtgagatcgcaagggacgttcatgtgaaacaggttaagccaaaaaagcagtcctcactttggtggatgtacattcctgctttgctctccgttctggtctttatgatttatccgtttgtgaaaggcacattgattacctttacaaactggaacggcttttcacaagtttaccaatgggttggattcgcgcaatatgaaaggctgttttctgatcctgacacttggcatatcttaaaaaacacgctgctttacgggcttggcagcactttttttcaaaatgtggtcgggcttctatacgctctgctcttaaatcaaagcattaaaacgaaagcggtaacaagaacaattgtgtatttgccggtgatgatcagcccgctcattatgggctacatatggtactttttcttctcctatgacggaggcgcgctcaacgatttgctcggggtcttcggcatcagccctattaatgcgctcgccagtccctcgctcaatccatggatcattgtcatgattaacacctatcaatatgtcgggattgctatggttgtctacttagccggtctgcaaagcattccgaaagactactatgaagcggcgcgaatggatggcgcgaaacaaggccagcagttttttaccatcacgctgccgctgttaatgccctccattaccattaatatggtcatcaatattatcggaggcttaaagctgtttgacgtcatcattgcactcaccgcgggcggtcccggaaatgcgtcacaatccatgtccacgtttatgtatgatttgtatttcaaacggcaggatgccggctatgccgcaacgcaaggcatatttatggcatttgtcattttgatcatcagcttttgcgcgcttgcgtactttaaaagaaaggagacggaaatgtcatgagagccgtccgtacaaaaaacatgcggatcattacgcttcttgccgccattgtggcctgtgcgcattttattcctttttatatcctgctgaccacttcattgaaagcaaaaggagactacagttcgaaatggatatttccagccaacatctcctttcacaatttctcagaggcgtgggagcgcgcttcgctaggtaactcttttataaacaccatgatcatcacaggtttttctgccttgttattaattatattcggctcacttgccgcctacccgcttgcccggagggaaacgaaactgaataaagccgtttttgccttgctgatttccattatgatcatccctccgttaacgtccatggttcctttgtaccgaatggtcgtggacgccggaatggtcaatacacacgcaatcgccattttcatcaatacagcagcttacatgcctttaaccgtattcttatattcaggctttatccgatcgaccattccaaaagagcttgaagaagccgcaagaattgacggcgcaggcatgctgaaaatcttttttacgattgtgtttcctctgctgaagccgatcactgcgaccatctgtattatttcttgtgtctttatttggaacgactatcaatttgccattttctttttacaagatcaaaaggttcagacattaacagtcgccatggcaagtttttttggagaaaacgcaaacaacctgcatttagttgccgcagcggcacttatggcaatgctgccgatggttgttctgtttttggcgctgcaaaaatactttattgccggcctgtcttccggagcggtaaagggttaacattaaagggggaagcaatatgaaaaagattacatttatcggtgcagggagcacgattttcgccaaaaatgttttgggagactgcctgttaacagaggcactgaatggatttgagttcgctctttacgacattgatcccaaacgcctgcaggaatcccagctcatgctcgaaaatctaagagaccgttataacccaagtgtggccatcaacagctatgatgacagaaaactcgccttgcaaaacgcaggctatgtcatcaatgcgattcaggttggaggatacaaaccgagcacagtcatcgatttcgagattcctaaacggtatgggttgcgccagacgatcgccgatacagtcggcatcggcgggatattcagatctctcagaacaatcccggtcttatttgatatcgcaaaagatatggaggaaatgtgccctgacgcatggttcttaaactatacaaatccaatggccactcttacaggcgccatgctccgctataccaatatcaaaacaatcgggctctgccacagtgttcaagtgtgcacgaaggatttatttaaagctctcggaatggagcatgacggaattgaggaacgcatcgcaggcattaatcatatggcttggcttttggaagtcaaaaaagacggcacagatttatatccagaaatcaaaaggagagcgaaagaaaaacaaaaaacaaagcatcatgatatggtgcggtttgaattaatggataagttcggctattatgtcacggaatcgtccgaacataacgcagagtatcacccatactttattaaacggaattaccctgaactgatcagcgagctgcaaatcccgctcgacgaatatccgagaaggtgcgtcaagcagattgaaaattgggagaaaatgcgggatgatatcgtcaataataaaaaccttacgcacgaacgctcaaaggaatatggttcaagaattatagaagcaatggaaacaaacgaaccattcaccttcggaggaaacgtcttgaatacagggctgatcaccaaccttccttcaaaagcggttgtggaagtgacatgcgtcgccgacagaaaaaaaattacaccgtgcttcgccggagaactgcctgagcagcttgccgccttaaaccggacgaatattaatacacagctgatgacaatcgaagcggctgtcacacggaaaaaagaagcggtttaccaagctgcaatgcttgatccgcatacaagcgcggagctttccatgaaggacatcatctccatgtgtgacgatttatttgcagcacacggcgattggcttccggcatacaaataaaaactaggggaccgctctcccctagttttttggttttgtttcgccttcccaggccatcatgccgccttcaacattgactgttttaaagccttgctcatccaggtacttgcagacgttcatgctgcgcattcctgagcggcagataaatacgtactctttgtctttatcaagggtttccattttttcaggaatatcccctatgcgaatatgaacggcttgcgggatcatgccttccgctacctcttcatcttctctgacatcaattaaatataattcttcgtccgcctcaattttttctttcaaagcggctgtgctgatttcttttatttccaaagaaaacactcctattcacagtgatcatgttcagtatatcaaagtcagctgaacgattgctattctgagactgatgaaaaaaatccccttttggcaaaggggattttttctaggcttagtttgccacaatattgacaagcttgccaggcaccgcgatgattttccgaatcgttttgccttcaagctgctctttgaccttttcatctgcttgagcaagctgttccagctgttctttcgttgcatcggcaggaacctgtaatttcgcttttacttttccgttcagctgaataacgatttcaacttcatcatccacaagttttgtttcatcatatacaggccaagcttcgtaggcaattgtgccggaatggccaagcttctcccaaagctcttccgctaagtgtggcgcgacaggagaaagaagcttcacgaagccttccatatattctttcggcagttctgttgctttataagcttcattaataaagaccatcagctgggaaatacccgtgttgaaacgaaggccttcataatggtctgtgactttcataaccgtttcatgatagacgcgctccaatgtttcacccgcgccttcaacgattttgtcattaagctcaccgctgtcttcaataaataggcgccatacacggtcaaggaaacggcgcgcaccgtctaatcctgattcagaccaggcgattgaagcatcaagaggtcccatgaacatttcgtacaatctcagcgtatcagcaccgtgagaggccacgatttcgtcaggattgacaacgttccctttagatttactcattttttcgttgttttcgccgagaatcattccttggttgtacagcttttggaacggttctttcgtcggcactacgccgatatcataaaggaacttatgccagaagcgggcatacagaaggtgaagcacggcatgttctgcaccgccgatatacatatcgaccggaagccatttttccaatttttctggtgatgccagctgatccggattgtgcggatcaatatagcgcaagaaataccagcagcttcccgcccattgcggcattgtattcgtttctcttcttccttttttccctgtctcagggtctgtgacttccacccactctttaatgttcgcaagcggtgattcgcccgttccgctcggtttgatttcatccgttttcggcaaaatcagcggcagctcctcttcagggacagctgttgacgttccgtcttcccaatgaatgaccggaatcggctcgccccaataacgctggcggctgaagagccagtcacgaagacggtatgtcactttcttctcaccgtttttcgtttcttccagccaagcgatcactttttcaatcgcttcctgtttgtgaaggccgttcaggaaatcagagttcacgtgctcgccgtcgccagtataggctgcttcctcaacgttccccccttttacgacttccttcaccggaaggccgaatgttttggcgaattcaaaatcacgctcatcgtgtccaggaactgccatgacagcacctgttccgtatgatgcaagaacataatccgcaatccaaatcggcagtttttctccgtttacaggattgatcgcatacgctcctgtaaatacgcctgtctttgttttcgcaagatctgtgcgttctaggtcactctttgattgaatttctttgatataagcttcaacagcttctttttgctctgccgttgtgatgttttccaccaatgcgtgttccggggcaaggacagtgtatgtagcgccaaacagcgtatctggtcttgttgtaaacaccgtaaaggaatcatcatgtccatctatagcaaaatgaacgtgagcgccttccgaacggccgatccagttgcgctgcatatctttaatgctttccggccaatcaagctcttccaagtcctcaaggagcctgtccgcataagcggtgattttcagcatccactgcttcattgggcgtctctctaccggatggccgccgcgttcgctcttgccgtcaatgacttcttcgttggcaagaacagtaccgagcgcagggcaccagtttacaggcacttcgtcaacgtaagcaaggcctttttcgtatagctttaagaaaatccattgcgtccatttatagtattcagggtcagtcgtattgatttcgcgatcccagtcatatgagaagccaagcgcttgaatttggcggcggaagttatcaatattctgcttcgtaaacacagcggggtcgttccctgtgtcaagcgcgtattgttcagctggcaggccgaatgcgtcccagcccattggatgaaggacatcatagccctgcatgcgcttcatgcgggacagaatatccgtagctgtgtatccttcaggatggccgacgtgcaacccagctccagacgggtaaggaaacatgtccagcgcgtagaatttttgtttttcattattatcaagagtggcaaatgttttgttttcaagccaatatgtttgccatttcttttctatctctttgtgctgaaaactcaaagtaaaaacctccttctgattgaatacggcgtgtatggttcaagtattgacgggaaggagaggattattcagaatattcccaaactaaaaaaaactccctcatccctaaaagggacgagagactttcgttttcccgcggtaccaccctcgttagcgcggcatacgccgcactcacttgatacttttaacgcagttatgcgtcagcggcttttcaccgctgcaactctgaggtgagttcggaaacaaacttgattgactttcaccagccgtcaactctctgcaacaatatctgtttcttactgctcctcttcattgttcttatcgcaaccgtaatctaactgtattttatagaattctgttcataagtgcaagcaggtttgtatacaatgggaatgtaccctgaacgggcggagattgaggacaattattcgggtggagttttggtttgacgtttggactcggccggttcgccgccgctgttcagttctctcacaaagtcaaaacttctgagaacagcttcaccgccgtagcctgagataatggataagatgacaagttgaattcctgaatcggggtcagcggataatacaagtaaaatggaagccgtcatgccgataaaccaatcttccaaaaatccaaggtagataaaccgcttcgtcattctgggcttctccagcctgcctctctttttcacatgaccgagaatccccatgattcctccaattacacaagcaatgagtacctgatgcagcatcttcatcatcaccttcctaaagcccttatttcgtaaagcgacttcaggccatccagcccccttaaacgattccgatgattttcgatatctacataccggcaaatctgtaaaaagcttgtttcttccattatatgtgaacacatgatcggtaagcttgatgcattggattcatttttcacccagtgacattgacctagtcacctatttagcatgtaaaaaacctttccgttcatatgttcaaattctgttcttatttttagtgtatacgaggacaagccctaatgacaaacaacaaactgcacttgcttgaatcagaacatgtgttgtgctacggttactgtagaattcattttaaaaaggggaatatcaggctttcgcatagcaagctgacggcctaagggggatttatatggctagttttcaatcatttgggataccaggacagctggaagtcatcaaaaaagcgcttgatcacgtgcgagtcggtgtggtaattacagatcccgcacttgaagataatcctattatctacgtaaatcaaggctttgttcaaatgaccggctacgagaccgaggaaattttaggaaagaactgccgcttcttacaggggaaacacacagatcctgcagaagtggacaacatcagaaccgctttacaaaataaagaaccggtcaccgttcagattcaaaactacaaaaaagacggaacgatgttctggaatgaattaaatattgatccaatggaaatagaggataaaacgtattttgtcggaattcagaaagacatcaccaagcaaaaagagtatgaaaagcttctcgaggattccctcacggaaattactgcactttcaactcctattgtcccgattcgcaatggcatttcggctcttccgctagtcggaaacctgacagaggagcgatttaattccatcgtttgcacattgacgaatatcttatcaacatccaaagatgattatttgatcattgatttatccggattggcccaagtgaacgaacaaacggccgaccaaattttcaagctgagccatttgctgaaattgaccggaactgagttaatcattaccggcattaagcctgaattggccatgaaaatgaataaactggatgccaatttttcgtcgctgaaaacatattcaaatgtaaaggatgccgttaaagtgcttccgattatgtaaaaagatcccgctcacccagcgggatctttcagattgttgacaaaatcctaaaatggttttcattttaggattttgtcatcttttcagcgtgattgaaaacccttgaagtctaggaaggacgagcataggagcggagcgaatgttctaattcgtgagcaccgaagcgcaggcctgacaacgaatgcgagggtttgtcgacacgctgaaagatcccgctcatccggcgggatcttttattatgaagagattgatgcctgcttatttgtttctttagctgattttatccgtttgtcatatagaagcgttgtggcaatactgatcagcagcaataccaacagagataaaacaagagccctaatgccgtaatgatcgacaagcactcctccgaacaggggaccaatcattctgccgcctgtcgccgcactgttgacaaagccttgataaaagccttctttccctttaggggcaagctgattggcaatagtcggcacagcaggccaaacaagcatttctccaatagtcaggatcaccatcgcagcgagaaacatcggaaattgctttgcagtcagcagcatgctgaaagacacaataaaaatgataaagccgatgaccatttgcgcttttagcgactcggcccattttttcaccacaaaactgacgagcggctggccgagcacaatgagaattccgttaaccgtccacagcacgctgtataaggaaagagatattccaatgctttgtgtgtacgaagcaattgtggttgaccactgagaataagccagccatccgagtacatagcctccgcttaaaatgatcagtgcggcaaattttgctttgctgttcacagcatcgtaatcaagcacagacgtttgggacgcatctcccgtctgaatatttcgaaatccgaaatatacaataaagaaaaagaccagatacagcgcggcattcgccaaaaatacatatgaaaacgagaaagacgccacgacaccgccaagcgctgaaccgacagccacacctgcgttttgcgcgacatatatcgcattaaatgccttccttcccccttcaggccataccgatcctgccattgcgtagctggccggaaaaacaacaccggagccaaagcccacaatcgtcagcagcacaatataggctggccaatcatgaaaaaagacaaggcccatcaggcttgctaacgtaatggctatcccaagcataatcgatttaaaaccgccgattttatcaaacaaaaaacctccgcataaattgccagccacactggcgccggaattcagcatcaggacaagtccggctactgttaacgactttcctaaatgattatggatataaatcgtattcagcggccataaaaaagaagcacccgtcacattgataaacattccaatgactaaaattttaagagcacgcggcatactcatccccctttcttacctaaaaaagctcatgaaaaaaacgaaacctaaaacggctccgtacgaatccagttatcatagcacattcattctatctgtctctctcacatttttcaactgatgagcgtgaaaaaatctaacaaatattgtttgaaaaatgtaaaataaatagaaaaagggggcatattatggaaatggcattagcattcttaggttttctggcatgtctcattgcactgggctatggattatatcactttgtcagatatgtactgaaaaaggaaaaacgtttctccaagagacttttttggccgcttttcattggaggccttgtgctgctctttaccggagcagcattggcagaacctgacacttccgcagcaaatgccgagaaaaaatattcagcgctaaacgccgaatacaaaaacctcacaaaagagcatgaagaacttgagaaagaatataaatctgtcagctctgaagcaaaaaaattaaaagacaacaaagaagatcaagacaagcttgagaagcttaaaaacgaaaatagcgatctaaaaaagactcagaaatcattaaaagctgagattaaagagcttcaagaaaatcaaaagcagctcaaagaagatgcaaaaacgacaaaggctgaaaatgaaacactccgacaagataaaacaaagcttgaaaatcaattaaaagagacggaaagccaaaccgccagttctcatgaagacactggaagttcttcaaacaatacgagtaaaagtgatgaaaccaaaacagctgacaaagcagaaggctgtaatatcaaaggaagcaaaaacggcatctaccacacgccaggcagtacatactatgaccggacaaccgatccggctgaaatgttttgctcagttgaagaagctgaagccgccggttatcgggcgccaaaacgataaacaaaaagctccagtatgtctggagctttttctgtttcacaacgacgatttaatgaccttcttataataaagaactgacagaaaaccaaaaatggagtagagcgcagtatataacaccatcaccataatcatgggcgcccatatctctgatccgaataagaaccagccggattggacggcaaagtaactgtggaagagcccgacaacgagcggaatgccgaagttatacatttgtttgatgcgtattccctttattaggtcgccctgcgtaaagccgagttttcttaaaatcgtatagctcggtttttcatcttcactttcacccatttgtttaaaataaaggatacaacctgatgtaatcaggaacgttaaccctaaaaagccgacgatgaacatcaccataccaaacagtgatttttgcgcagcgcttgtatccaatcttgataaatgctcgtttttcttgttcacctgttgaaaaagctcatttgctttttccatttgatcttcatgtttcacattgacgccgataaatgtagattgcgccagctgaattcgggggtctttatccttgttcagctgtttaaacaggctgtcatccacaatgacagcgggcatgcccccgcttgtaaacgtgtaggatacaagaaactcttctcttaatcctttatattttaatggctgcgtctcatgtttgctttttactttaataacaccagagtccttgaaaaccattattttttgcagcaagtcggtgtatcctgagaaaacggcttctccagccgccacatcgactccttttacatctttgtcgctaacaacagcaagctgcatattgctgggatcgccctgcatctctttcggagttccatccataatatttgcaatgtcaacatttgcttgcaggacaggtgttgccttttttacaaacgagatgttgctttccctcaatttgttttcaaataacttggcatctttctcattcatgaatgaaaaatcagccgctacattttgttcagcggtcttttccgacgagtaatacgagatgtaagcaagagataacagcccgatggcgagcgctgaaacggttgtaataatcgtcagcagcagcgcattcgatttcattctgaacatgatcgatgacagtgacagaacctcagaaatatttaagtagccgcccttgctttttcgaatgatattcgagataaacgtaactgatcctttataaaacaaaaacgtcccgataatgacgctccccagaatgaagctcatcgcaacaaacagttcattaatggtcttaaattttccgccaaacagctcagaagacacatagtatcctgtcaaaatcaacacgatgcctaaagcgccgatcagcatttggaaaaatgatattttcttcactttgtcttcagtggaggacgttactttaaacaaagataaaatactctgttttttgataaacgtataattcatgatcatgatcaaaaggtaaatgccgcagaacacaatgaccgtttggaccaaggcctgctcagaaaaatgcagtttcgcatccgctttgacatcgacaattttgaacagaatcatcaagacaagcttcgatatcgaaaacccggccgctaccccgatcgctaatgaaccgaaatacagcatgacattttctgcacttaagatgcgaaaaattttatgcttcgtcattccaattaattgaaacagcccgatttctttactccgtctcttaataaaaatcgtattggcatataaaatgaagatcgccactacagccacaagcaaaatcgaagcggttttaatagccgcggctcccttgattgaagccttcacttcgttaattgctggatcatactgcagcgtgacaaaggcgaaataaagcgccacgctaaagatgagcgcaaacacatacaaatagtaattccggagattctttttcaaatttcgcaggatgagctgattaatgttcatgctgcaccccgcctaacacgccttgcgttttcataatatcctggaaaaacgtttgcctgtcctggccccctttattcagctgtgtatacatttgcccgtccttaataaaaatgactctgccgcagtagctggcagcgacgggatcatgggtaaccataataatcgtcgcgttgcgtttttgattgagctggctcagcttatttaatagatcggaggccgatttcgaatcgagcgcgccggtcggttcatcagcgaaaataatgctcgggtcatgaataaacgctcttccagcggatgttctctgcttctggccgccggaaatttcattcgggtatttatcccgcaattcatatattcccagttcctttgcaacttcctcaaacttgcgattggcttccttttttgatagtttcgtgatcgataaaggcagaaggatattctctttcactgtcaatgtgtctaacaaattgtaatcctgaaagataaagcccaaatgctgttttctaaattcagccagctgcttttccttcatagccgtcatgtcatttccattaatatgaatggttccgtgactgacctgatcgattgaggacagaacgttgagcaaagtggtttttcccgacccggaagcacccataatactgacgaattcgcccttttcaatgtgaatatcgatgcccttcagcacttcctgtttattcagcttgtttccataactttttcgaattttattcgcttctaaaatcaccatttacgcagtctcctttatattggataatctcattataaaaaggaatgccgggcttttccttcgatacggcgaacaaaaaagaaaagcatgtgacattttcgtcacacgcttatgacatgttcaaattgattccgtattggaaaggttaatgtaaaaactgttcccgcaccaaactccgactcaacatcaatatggatcaataacggcgccgctgctttttttgccaagtacagccccatgccagttgacgcttgatcatggtgatccgttgtggatgtaaaccctttatcaaaaatacgcggtacatcttttggatcaatgcccctgccacagtccttcacttggagctgcgtctgttcccctttttgaaaacttttgatctcgatttcagaggcttcgctgtatttcaccgcgtttgtcagcagctgcctgatgataaacgccagccattttgcatcgctcagcacttctttggcctcgagctgtatgtcaaaaccgatccctttttggatacaccacgattgcaaatctttgatttctttaaagatcaaaggctgaagctgaatgaattctacagacagatcgttttcaataaatgatatccgtttttgatgaagctgctgatcaagaagcagatgaatacgcagccattcatatgacagctgggatttcagtgctttttcttccattctatcaatgattaaatgcatcgctgttaatggagttttgacctcatggatccatgccatcagctcatctttttcattttccaatgctaagcgatgccgtgctgcggtctgcttcaagtgttctgtttgcccggcaatgcttctttcaaccattgcttcaaacggcgtttccggttcatttatggctgtcacatcgagattgttctcccatgttttcaagcttttataaaacgctgtttctttccgatagcggaaccaaaggaatatgataaaaaacaaaatgcacaaatacaccatataaagtacattcccaaatgatatggaaggatcgacaaaaacaatgaacagcatcaaagcctgctgaaacaaaaaagcggcaatccagctccgcctttcgataaggaatgctttaatcatagaacttgtcctcttccttcgcgatgtagccctggcccacctttgtctcgatatatgcaccaagctgcagggcgtccagtttttttcgcaggcgattgacattgacggtcagcgtattatcactaacaaaacgctcatcgttccacaagcttctgatcagctcttcccggctgacgatcttgtttttttgctctattaattgttttagaatgaacatttcatttttggtcagttcaacagatcctttgtcattgctgacgaggttctgctccgcgtctacagcagcgccgcaccacgttttaatcgtattcggctccgtattataatggtgcacacgccggaacatcgcttggattttcgcaatcagcacatcaaaatgaaatggcttttggataaagtcatctgccccgagctgcatggacatcaccatatcagcaggatgatcccgggaggataaaaagagaatcggaacatttgaccgggagcggatcagccggcaccaatgaaagccgtcaaatttaggcagctgtacatcaataatgacacaatcaggattaaccgccgcaaattcctgcagcacctgactgaaatcctgaatgccgtatacatcataggaccatcccgttaaacgatccttgatttcatgaaacagcgattcatcatcttcaatcagcaaaagtttaaacaatcaactcaccgcactttttccttttttatcaagtgtatagcaaaacgctatcatgcgctatagaaaaagccggctgtctcagccggctcgttcgcattatagttctcttctcaacgctgtcagcacgttggtttttgttgcttttctcgccgggttcattccggaaatgactgcgacccctccgcaaatcacaacggcaatgatcacaagactcgccgggatgtaggagaatgtgtaattcaagtcgcccgcatcgcttccgcttgtggccgcaagaatcatcggaacggccaggttgacaaggtagctcacgccgtaagaaatgataatcccaatcacacagcctaaaattccgatatacgcgctttccatcaagaacattcggcgaatgattgacgggctcgccccaatcgctttcataatgccgatctcttgcgttctctctgtcaccgccatcgtcatcgtgttaaaaatgccgatcgctgaaatgataactgcgatacatccgacaaagatcagtccgattttgaagaccatgaagaaggtattggctccctcaagttcagtagtcactgatgtgacatagtacccgtcatctgttagatcatttgtcagctgttccacattctcaaacttatcagcaaaaacaccaatgttcgtttcaacatttccgcctttgaaatctaagaattccgaaaaatcttttttgaattgatcactgataaaaatgtttgagtcctccatccagtcttgagatggtttttttgtaataccgacaattttaaagtcatatgtttttgtttttgtaacatcccctgttttaggatctgtcttcgatacacttagttctattgttttgttcagaatatctttcgtatagccctttggttcttttatatcttctggatttccttttgcttcttcgatttttttgttatattcttccgattcttttttcgtcaataatctctttgcgaagtcgtatcctactacgatttcattttccgactttgcgactcttcccttttccaattccatattggcctttaattcatcattcatattagtaaaaatgagatttgagctttcatttgtacgattgcctaaagtagctttgtttggttcatacacttgcgttctttctacaactgaccttacgtgatcatacttctctaaatcagcttttttaataggcttgtctccttccttgcccattacactgactttcgttacaatctgctggctcattgtcatatctgtaattgtcttttgaatcccaaatccaacggacgacaacacaaccaaaaacgcacacgccattgttgtcgccagaatcgtcataaagacgcgaagcctgtttttcttcatatttcttctgataaaatgaacctgatccttaaacctcaacggtaattcctccttttagcacaccatcatgaagctgaaattttgaatgtccgatagaagcgacttcatcatcgtgagtaatgatcacaaatgtaatgccacgctcacgattcagctgctggatcaattccagcacttcatgttccgtttctgaatcaaggcttcccgtcggctcatccgctaagataatcgaaggatttaaaatcaatgctcgagcaatactgacacgctgctgctggccgcctgacagttcattcggataatgagcggcgtggttttccagaccgacgcgtttcagcatgtcctgcaccttttgcttccgctcagatggcttgattccttttaacgccagcggcatttccacattctcatacgtcgttaaacccgggatgagctgaaagctctgaaaaataaacccgaaatggtcaagccgaaattgcgcccattccttttcattaaaccccgtaacatcagtgccattaatgacaatccgcccttttgtcggcgatatgtagccggaaattaaattcaaaagcgttgatttccctgagccgcttcgtccgacaatgcaggcgatttcccctttcgccacgctcaatgaaacatccttcaatactggaacttcattctcacggcccttttttccgatcgtgaaagaatggtcgatatgctgaacatcaatcatatgttctctctcccttacaaaagtttcattttttataaatcgcaaaataactaatcaagaaaccgattaccgcacctgtacccatgccaatgagataaccggcaaagctctcgcttgcagtaaatccaaaatagccgaagcccatgattcctatgataataacgatgatctgcaccgggcggttaagcggcttccataagaagaaatatccgtttctttcattagacattttaacaaagctaatatagccgatgatgtaaaaaatgatagtcatgatagccggaatgactaaataatatggtgaattctcagcccatttcgagtctacataaattatcggaatgaaatactgcacccatttaggtactggaccatggataaaatctattgatccgccaaaaaggatctcgaggttgatcgcaggcaggctgatgagcaaaaatggcgaaatggccacggtaaatgagactagaagctgtgcgaaactattgcctgtcaaagctccacccgccataacaagcgaataagccagcatgctgacaatgatcattccaaggctgtaattgtgaaaataaacggcctgatcaggcttcaaaagtatgatcagcaaaacagataaaacataacctatgagctgcggtatcacaatcaccattccgccagtaaggaacttcgcatgaaatatctgccctcttgtatacggaaggcttaatgtaaaatcaaaaaagcccttgcttcgttcaatccctagctggctgaccgccaaaacgactccccaaatccaaaacaatgagataaatgagctgtttaaataatcaacgctgaatacgcaggggccgacccaattttcttttccagtgacacagccttgatagatgagatacatatttaaaattgataatggattacccaatataaaaaccaaaatggtgataactaaggcgactttattctgccgccactctttgtaaagcagtccggaatccggcaactcacttccctccaaacctatggcatttcttacacttttgttttcttataaatagagaagtagctcacaaagaatccagccactgccccaatgatcatacccaaaatataaccaataatggaatgtccggtatagtatccaaataaaccaaatccaaggatgccgaaagccataaccagaatttgcaccggacggtctaatctgttccataagaaaaagtgtccgtttcgttcacttggaagcttcttgaagcttataaagccaatcaagtaaaatagcatgctcattacggctggaatcaataaaagatatttactgttaatcagccattcatttacaacgtaactaatcggtactaggttcgataaattgcttgccagagagaaataactctcaggggaagggaatatttcccatatattcgcaccaaaaacaacttctaggtttccaaccggcaatgcaataattaaatacggcaatatagctgctgaaaacgccgttaacagttgggcaaaagcatttccagttaacgctccggcggccatcaccagtgaaaaagccataaaacttatcacgattactccaatgctgctgtgctcaaaaaagtagacgtgttcagggttatagacaagaatcagcagccatgcaagtaaaaagccaatcaattgtgacagcacaatcacaaaaccgcctaaccaaaattttgtctgaaaaatttggcttctgttatacgggaggcttaatataaaatccatcgtgcctttcgaacgctccattccgaggaagcagaccgccaaaatgacacccggcacccagttgatatctatcagattgcttatggaataattcacaataaaatcacaatattgcgggtcttggcgatcaagacacccttgataagacaaatacgtattaacgatagaaagcggatttgccaatactaaaaacgcgatacttaacaaaatcaccacttgattctgcttccactctcgatagaggagacctcggtctaccatctccgcttccctccaaacttcgcaatgaacacttcttccaggttgacaggaagctcattccacacttttggcttcagctctctcaaaaagctctttttctcctcatcgcttttcggaatcagcactgtgtaaaacacgccggcctgatcgagcatcggaatgttttgctctctgatggccaaattgacatctgtatcgaaggccatttgaattttaatgtattcttcttttaactcatcaagatccatgacgttggtcaggctgttatcttcaagaaaaccaattcggttgcacatccgctctatgtcttcaagccggtgggacgtaatcaggatgctcgtatcacgctctgccacttcatcgaccatcagctgcagcacatcatgccttgtcaccgcatcaataccatccgtcggctcatcaaggaggatcagcgccggtctcgccgcaaacgacagaacgagcgatagctgcttttttaagcctgtcgacagctcacggtattttttcgtttccggaatttcgtatctgttcatcagctcattcgcgtacgtgacatcaaatttcggatatattcttctcaaaatatcgactaactgcttgtatgtatacttatcgtaaaacggattttgaacaggcatgtagatgatattttgtttgactttcgggtgctttttgatttctacgccgtcaaataaaatcgttccgctgtcagcgaaaatgatttgctggattaagcgaagcatcgtcgttttgcccgatccattgcgtccaagcaatccaaagatttctcctttttcgattgttaatgaaacatcttttaatacttgattgccgtcaatcgcttttgacagctgccgcagttcaatcattttttttgcctcccttcacatcagcgctgatttcctttatccattcgtgcagtttttccagctcaacccctgcatagtgtgcatcgatgatgagctgtttgagttgctctttaatcatcgtcatcttcccttcaaccagtgtcgtttttgcattctccgatatataggtccctctgccccgcagcgtttcaataatcccctctcgctcaagttctttatacgctttgctgacagtgttcggattcgcaataatgatcgttgccaattctctgacagaaggaagcttatcaccaggcttcatgatccctttcaaacaaagctctttcatttgctgaataatttgttcgtaaatgggtgttgagcttcttggatcgatttgaatcatttacttccctactttctatacgatctgaaccttttatagataaaaatgatcaattatacttttttgccattcaaaaccgatcatcacaagaacaagaaaaaaagaacaagcgatcacagatgccgcaatcagcattggcacgttacgtttgtttcgttttttatgtttcataactgcctcccttaatgtcaatatataaatgattttatattagtgtctatagtgtattacttcaattagtacacttaatacaataaatactttgactcacaaagtcaatcctttttttacaaaaaaacggacccttttaaaagggtccgttttcctacacatcaagagggtgctgcaggatcatattattttgcaaagattgaagctgaagtctcattctgtacagctgttctctctgctgatcatttgacgacagccatagtttattcaaggcatttaccgcatcttctagctgcatttgtgcatcactatattcttgatcgttataatgctcttgtttagaagcgattttcagctgttcttcagcataatcataggcctgcatacattgctggagatgttcatctactgattgtcttgttgccacagtaacccctcctcttggtaatggaaatcatccatcattcatattgtagcctcatctgactttattcaataaagtaatttatggtcgatattcatttgttctcttgtgaaatgcgtgctacaattttaggatgcaatcgtacgcaaggaggcacatgaattgtgatacagaacaatccttttccttattcaaatacggaaaaacgctatcatacattgaattatcatctcagagatcatttcggccataaggtgtttaaagtggcgcttgacggcggctttgactgcccaaatcgggatggcaccgttgcccacggaggctgtacgttttgcagcgcagcaggctccggcgattttgccgggaaccgggccgatgatttaattacgcaattccacgacatcaaaaaccgcatgcacgaaaaatggaaggacggcaaatacatcgcttattttcaggctttcacaaacactcacgccccggttggggtgcttcgcgaaaaattcgaatcagtgctagcgcttgatgatgtggttggcatttcgatcgccactcgcccggactgtctgcctgatgatgtcgttgattacctggcagagctgaatgaacgcacctatttgtgggtggagcttgggcttcaaacagttcatgaacggactgcacttctgatcaaccgcgcacatgattttaactgctatgtggaaggcgtcaataaattaagaaaacacggcatacgtgtctgctcgcatattatcaatgggctgcctttggaagaccgggacatgatgatggaaacggcaaaggccgtcgcagatttggatgtccagggcattaaaatccatctgcttcacctactgaaaggcacgccaatggtcaagcaatatgaaaaggggaagctggaatttctttctcaagatgattatgtgcagctcgtctgcgatcagcttgagatcattccgcctgaaatgatcgtccaccgcattacaggtgacggaccgattgagttgatgatcgggccaatgtggagcgtcaacaaatgggaagtgcttggcgccattaataaagagctagaaaatcgaggcagctatcaaggaaagttctttcagcggcttgaggaggaatcagcgctatgattttgaagaaaattcttccctacagcaaagaactgctgaaaatggccgcgggagaaggagatattgtcgtagatgcgacaatgggcaacggacatgatacacagtttttagcggagcttgttggtgaaaacggtcatgtgtacgcattcgacatccaagaatcagccgtggccaatacaaaggaacggctcggtgacatgtatcaagcgcgaacaacgttatttcacaaaagccatgataaaatcgctgaatccctcccgcctgaaacacatggcaaagtggcggccgcggtatttaacctcggctatttgccgggcggggacaagtcaattacgacaaacggcagttctacgatcaaagcaattgaacagcttctcggcatcatgaaagacgaaggtctgattgttctcgtcgtctatcatggccacccggaaggcaaagctgaaaaaaacgacgtgctcgagttttgccgggacttggaccagcaaacagcccgtgtattatcatacggatttatcaatcagcaaaatgacccgccatttattatcgccatcgaaaaaaaagctcagatcagcaaatgatttgagcttttttctttgagtttttcatccagaacattttttgaaatttccggtaggctctgccgttgatataaaagaaaagggaggtttttccgctggctttgatcagcttctttgcgagccggcccatttccttttggcccgccactttatcatctgacaaataaacgccaagcaagccgcgattgattaaacgatggaagttttcatgcggaatgccttgtaaatgctcgtcagctttatggataaagtgttcaagccgattcatcatctcttcatgagactgataatacgagcagaaattcaagtctccttccagcaagtcctcctcttgatcaatcaaataatcaagaagaatatgaaggccctgtatgtaaggaaaataactgtcgcggatttttttagcggtgctttctgtgaaatcaggctggaacgaatacgcaaccagacagaaaatgcctaacgttgagcctgcacaggctgaaaattcataccattccatctcaggcagctctgattcatattgagtaaaccacttttcaagccgcggaacacgctcatgctcaataacgtgcttatgcacctgcaaatcgcaataatagccgcacagttcaagcagataaggtttaatcatgtcatagtgctcaatggagccgagaacacgctggcacgttttgaccagttcatgcaaatatccgctgtcatcctgttcttccctgaattgataatagttttgcagttccgccccaactgtcagtgcgtcctgcattgaggcatggagcatccgaaaatcctgcgggtccagcgaggtgctgcggtcacacagattgtccaaataatcactaatcgtttgatacgcgatgataaactcgacacatttctgtttttggctgcctgacaataaggccagtatgccgccgccttcacagtgaaacgttttgtcccgaatacttgcggttgcctgtgctttcaattcactgttatgaatcgattctgatttttgcttccatatgtccagctcttgatgaacgagcggaaaaatatctcgatatacctttgccatcaatccaaaaggatgttccggtactgtcaacacatgcaccccctactagttcaaatatattgatcagtaaacgctcttgctgctttaaaaacatcttctctctcgggttcattgaagatctcatggtaaagcccttcccactctctgtatgctttattataagaagcaacaccattaaaccacttgatgaccatcgttttgtcaacaagcttgtcatcaccggcttgcatcacaagaagcggaactttcaaaaatgcctctgtcggcaccattgccgattcaattgtctttaaaagctctctgtaccatctgacagaaactttcctgacgtataacgaatcattttggtcagcctcaatgacgtcctcattgcgcgtcgccatatcaattgataatcccgaatcaaccttaagtgacggagcgatgacattcaggccttttgatgcaagatcaagcgctttattcactttaatttgcagtccgagacacggtgatgataaaataattcccgtaatcttgggatttctttgctgtttaatccattcaatcgcgaccagaccgcccatgctgtgacctagaagaaaaaccggcagatcaaaggttcgcgctttatctatccaagcatctacttcatcaatgtattcttgaaacgagcgaatatgccctctcgctcttgtcgttgttccctgtccaggcaaatcgcccatgacaacgtgataacccgaagaccgccacatttcaatcagccatttatatcgtccatgatattcacttgccccgtgaatgattacaatcacggcaacaggtctgtctgctttccaggtccacatgatcttcacctcatacgaaatttaaatagagaaagaaggatgaatcttatgatctacccttataaggaacacaagccagatatccacccaacagcctttatagctgataatgcaacaattaccggtgatgtcgttatcggagaacagtccagtatttggttttctgttgtcataaggggagatgttgcgccgaccagaatcggaaacagagtcaatatccaggatttaagctgcctccatcaaagcccgaacaagacgctgctcattgaagatgacgccacgataggccatcaggttacacttcatagcgctgttatccgcaagaacgccttaatcggcatgggctcaatcattttagacggagccgaaattggcgaaggcgcttttattggtgccggcagtcttgtcccgcccggaaaaatcattccgcctggccatctcgcctttggccgccctgcaaaagtcatccgccctttgacggaagaagaccgaaaagatatgcaaagaatacggtcagaatatgtagaaaagggccaatattataaatttcttcaacaaacataagacctgcttcgtcttactttaccatttttcaaattatatttgaaagcaataaccatcgttaacccggacgtcataacagttcgggtttcgatttttccataaaacgttcacatatagcatgaaacgtatgacttttatcttatcacaaaactataaacagcctctgcaaaaacacatacctattctttcctgttctctattttctatgagcacacacaaaaagagcccactgggagctctttttgtcagctgatatttcgttcgctggcagctgctgcattttttttgtgaaacccttttccatagtacacagccagcaagatgagaaaccatatcggcccgataatcacggctactcttgtatcaggactgtaagccataagaatgacaacgaatgctagaaatgccaatgacacataagacgtaaacggaaataaaggcattttgtactttaattgtttcttttcttcaggcttcaaacttttcctgtattttatttgagaaagcaaaatgattgcccacgtccaaatcgctccgaacgtcgcaatacttgtaacccaagtaaataccttcgcagggacaacatagtttaacagcactccgactaataaagcgcccgctgaagccagaacagctttacccgggatgccgcctttcgtcagctgaccatatgcttgtggcgcctctttctgttccgccaagttaaacagcatccgccctgtgctgaaaataccgctgttgcatgaagacagcgcggctgtcaacacgacaaagttaatgatacctgcggccgatggaatgcccactttttgaaatgtgagaacaaatggacttccttgagagccaatttcctgccacggataaatagacataatgacaaataaagcgcctacataaaaaatcaaaatccgccaaaatactgtatcgattgctttggctaacgatttttgcgggttttttacttcgccagccgtcaccccgatcatttcaatccctaaataggcgaacatgaccatttgaagagacaatagaaccccttttaaaccatgagggaaaaatcctccgttgttccacaaattgctgattccggttgcaatgcccccattgccgactcctgcaataatcatcaataaaccgacagcaatcatggataagatcgcaacaattttaatcaatgcgaaccaaaattccagctcaccgtaagctttgacagccaggaaattaacacccgtcataatgaccagtgccgataatgcccaaatccagtttggcacgtcaggaaaccagaaccccatatagatgccgacagcagtaatttcggccatacaggtgacaacccataaaaaccagtagttccaccctgttaaatagcctgcaagcggtcccaaataatcacgcgcatacctgctgaaggagcctgcgaccggtttttgaatggccatttccccaagcgctctcataataaaaaacatgaccaggccgcttgcggcatacgctaccaaaataccaggccctgctaattgaatagctgatgcggagccgaggaacaaccctactcctattgcagctcctaaagacattaaagaaatatgcctttcttcgagtccgcggtgcagctcttgtttttgtttttgcatgctttcttctcccctagaaaaaaattcattaaatcatttttctgaatatttcgtatgaattgggtaaaccaatgatgatggagaaataaaaggataacaacaaggctttcgactactcgaaagccttgttgtctgttacacaaagatgacttctttaggctgatggctcagctcttcaggcatataccgtttttcaatattgatgctgtgccagatcataaagattagcacagtccagattttacggctgttatcagccttgtccgcacaatggtcttcaagaagctgaaggacataatccttatggatataagcatccgtttggctttcctgaataatattccgcacccattcgttcatttcgtttttcagccaatgacggatcggtacagggaaaccaagctttttgcggtttaatacgtgctcaggcacaattccttcagcggctttgcgaagaagatacttcgtcgtgccgttcttcgttttcagctcatcaggaatttttgaagcgacgtcgaatacgactttatccaagaacggcacacgcagttccaaagaattcgccatcgtcattttatccgcctttaacaaaatgtcgccgcgcatccaagtgtggatatcgacatactgcattttgttgatatcgctgtacgagctgctttctgtaaagtaagtcttcgtcacatcgcgatatgaaaggttcggattataatgcttcaacagctgctttttgacagactcttcaaagattttagcgttaccgatataacgatcctgaagcggagtgcagccgcgctcaagcaggctcttccctctcataccttcaggcataacggcagcaacgtgcagaagcatctttttcaagccggacggaatccgttcaaacggtttaagcgaaagcggttcacggtaaatgttatatccgccgaagagctcatccgctccttcacctgataaagcaaccgttacatgttttttcgcttcttttgcaacaaagtacaacggaatcgctgccggatcagcaagcgggtcatcaaaatgccatacgatcttcggaagctcattcatgtattcctcaggcgaaatgactttgctgatattttcaatgcccagcgccgctgccgtttctttcgctacatcaacctcactgaagccctgctgttcaaagccgacagagaatgtttttaagcttggatgaaattccttcgcaacagacacaataaaggaagaatcaatcccgccagacaggaacgaaccgacaggaacgtcacttctcatatgaacgtttacagagtcatagatcgcgtctcggacttctttcacaagcttgtcttcttcagtctgaaccggcttgaagttcgctttgaaatacgttttgaatgtgatatcgccgtccgggcggattgtgaactgtgaacccggctctacttttttcacatgggcatcaagcgtgcttggttcaggaacaaattggaaagacatgtactgctgcaatgcctctttatctatttcaatatcattctgagcaaccattaaactttttctctctgaggcaaaataaacctgatcattgatcgttgtgtagtacaacggtttaatgccgaatggatctcttgccccataaagcacatgatcgtttttattccaaatcagaaaggcaaacataccgcgcagtttggacgccgcttcttctttatagtgacagtaagtcgcaagaagaacctctgtgtccgaatccgtgttgaatgtgtacccctttgcttcaagctcttctctcagttcaatatagttatagatttctccgttaaagataatccaatatgtttcatcttcatatgataaaggctgtccgccattttctacatcaataatgctgagccgtctgaatccgaagccgacgtgctcatcatggaaatatccatcactgtcaggaccgcggtgaacgatcatttggttcatttgtttgattagttcttcttgatcagcggtttgagctaacggatgcttgttaaaaaccccgacaaatccacacatagtattgcctccataattaaaattgtcatcattgaacccctatttatagacgctgtgaataatatttggtttcacagttatgtaaaaaaataaacatgaatacaacgataaaaaagggaaagccgcttaaccagtaagcggctataaaattattctcctaacgcttctttacgcagctgctccgctttgtctgtacgctcccaaggaaggtcaacatcgtgacgtccaaagtggccgtacgcagcagtttgtttgtagatcggacggcgcaaatcaagcattttgataatgccggcaggtcgtaaatcaaagttattgcgaacaacttcaatcagtttttcctcagaagcttttcctgaaccgaatgtgttgattgagattgacacaggctgtgcaacaccgatcgcgtaagcaagctgtacttcgcaagaatcagcaagctcagccgcaacgatgtttttcgcaacgtatcttgccgcataagctgcagaacggtctaccttcgtcgcgtccttacctgagaacgcgcctccgccgtggcgtgcatagccgccgtacgtatcaacgatgattttgcgtcctgtaagtcccgcatccccttgagggcctccgattacgaaacgtcctgtagggttgatgaaatattttgtttcttcatcaatcagctcttcaggaacaaccggattgattacatgttctttaatgttgcgctgaatttgctcaagtgtaatttcagggtgatgctgagttgaaataacaatcgcgtcaatgcggactggtttgttattttcatcgtactcaaccgttacctgtgttttgccgtcagggcgaaggtacggaagaatatcttctttacggacttcacttaggcggcgggctaatttatgggcaagtgaaattggaagaggcataagctctttcgtttcgttgcacgcataaccgaacattaatccttggtcacccgcaccaatcgcttcaatttcttcgtcgctcattgtgccttcacgggcttcaagcgcttggtctacgcccatcgcgatatcagcagactgctcatcaattgatgttaaaaccgcacaagtttccgcatcaaatccgtattttgcacgtgtgtatccgatttctttaatggtttggcgaaccgttttcggaatgtcaacatacgtagaagttgtgatctctccgcttacaagaaccaaacctgttgtcacagatgtttcacaagcaacacgcgcgttagggtctttctttaaaatttcatctaaaatgctgtcagaaatctggtcacagattttatccggatgcccctccgtaacagattctgatgtaaataaacgacgatttttactcatgatttgcttcctcctgcacaaggcctcccgaaagaccttgtatatatgatacggaactcgctccctcttatacaatgtacagttatattagagaatgttaattggcatatttatgaaataaaaaaaccttttccatcgaggaaagggtttggtctttgtgcctttcactcttatcgctcaaggaatcatacaaccttgcaacaggttagcaccttggttgtctcactcagttgaacataataaataacagagaaaccggttgctgggcttcatagggcctgtccctccgccagctcgggataagagtatccgctcaatgaaatatcttatcgtaaaagggtttgcaatgtcaatatgattcagaagaaataggcacctatattgagggaaaacaatggaaatgcacacacaaaaaacaataaatagtatagactatttgaaaatatatgttatactaattcacaattagcaaaacacaaaaaacgataaaggaaggtttcatatgaactcagttgatttgaccgctgatttacaagccttattaacatgtccaaatgtgcgtcataatttatcagcagcacagctaacagaaaaagtcctctcccgaaacgaaggcattttaacatccacaggtgctgttcgcgcgacaacaggcgcttacacaggacgctcacctaaagataaattcatcgtggaggaagaaagcacgaaaaataagatcgattggggcccggtgaatcagccgatttcagaggaagcgtttgagcggctgtacacgaaagttgtcagctatttaaaggagcgagatgaactgtttgttttcgaaggatttgccggagcagacgagaaatacaggctgccgatcactgtcgtaaatgagttcgcatggcacaatttatttgcgcggcagctgtttatccgtccggaaggaaatgataagaaaacagttgagcagccgttcaccattctttctgctccgcacttcaaagcggatccaaaaacagacggcactcattccgaaacgtttattattgtctctttcgaaaagcggacgatcttaatcggcggaactgagtatgccggtgaaatgaagaagtccattttctccattatgaatttcctgctgcctgaaagagatattttatctatgcactgctccgccaatgtcggtgaaaaaggcgatgtcgcccttttcttcggactgtcaggaacaggcaagaccaccttgtcggcagatgctgaccgcaagctgatcggtgacgatgaacatggctggtctgatacaggcgtctttaatattgaaggcggatgctacgctaagtgcattcatttaagcgaggaaaaggaaccgcaaatctttaacgcgatccgtttcgggtctgttctcgaaaatgtcgttgttgacgaagatacacgcgaagccaattatgatgattccttctatactgaaaacacgcgggcagcttacccgattcatatgattgacaacatcgtgactccaagcatggccggccatccgtcagcaattgtatttttgacggctgatgccttcggagtcctgccgccgatcagcaaactaacgaaggagcaggccatgtaccatttcttgagcggttacacgagtaagcttgccggaaccgaacgtggtgtaacgtctcctgaaacgactttctctacatgcttcggctcacctttcctgccgcttcctgctcacgtctatgctgaaatgctcggcaaaaagatcgatgaacacggcgcagacgttttcttagtcaataccggctggaccgggggcggctacggcacaggcgaacgaatgaagctttcttacactagagcaatggtcaaagcagcgattgaaggcaaattagaggatgctgaaatgataacagacgatattttcggcctgcacattccggcacatgttcctggcgttcctgatcatattcttcagcctgaaaacacgtggaccaacaaggaagaatacaaagaaaaagcagtctaccttgcaaatgaattcaaagagaactttaaaaagttcgcacataccgatgccatcgcccaggcaggcggccctctcgtataaaaaacaaaagccaagagcaattatgctcttggcttgttttaattgacggaatgcaaagaagtcagcttgtatgtaatgatggtccggccttcttcccattgaagcttctgcacttcagctgtgcctgacttttcgccaaactttgttttgcgtacatccattggaatctccatcggatatactcggtatccgtccttctctaacgtgaatatattttcatctatgcgaacttcttttccttttgtcacaatcagtgtattaaattcaacaggcattcccaaagtgaaatcccctttcgttctcttttttctttatcataacatatttcactgtcagcggtttttcatccattgtgtgagctgccgcacgatacgccggttttcttttggcgggaaataatgtgtgaatgtactgtagtaccacgtctccaccggcttatgcagttgttttagcttctcttcaaataaataggaatgctgaattgaaacattttggtctttttctccatggattaacagcacgggagcctgaattttgtttacttggtcaaacggtgtcctccattgatattcctcaggcacctttttcggtgttccgccgatgactcttttcatcattcgccgcaaatcctgccgctcctcgtatgtaagaatcatatcactgacgcctccccaggaaacaaatgaagctgcctgcccgcccatttcgatcgcagtgagcattcccataattccgccgcgggaaaaaccgaagatgtggattctatccttcttgacatttgggtgctgctgaagcaggcgaaaagcagaaaatgcatcctccctgtcttctcctgcaaaatcctcattgccttctcctccttgatttcctctgtaaaaaggagcaaacaccacaaacccttgggatgcaaactggataatccggcccggccgaaccatgcccacgcttttaatcccgccgcgcaaatataaaaatccgtcatattgtcccggttccgccggctcagccagaagccccttaacccgtaatccatttgacagatagcagatcgtatacaaacgcacatgctggcttggcgacggaaatcttcttttctctacaatcaaaacagccgcctcctttttttctatatgctttccttactccaaaattacatccggagaacctggttaggcattcacacatttttatacccatcatacgatatgtaaagcaaaaaaggatattaacttgatgcgaaataaggaggttgtctatgtgaacagatggttaaggctgagcttcgcctgtgtcggcagtatctttctgatgttcgccctggcggcttgcaagcaggaagaaacgctcacaaaagtcaaggtcgctgaagtgacccattcaattttttacgcacctttatatgttgctgagtctaaagggttttttaaagaagaagggcttgatgtcgatgtgaatacgacctggggcggagataaaacgatgacatcgcttctttccaacggctccgacatcgcgcttgtcgggtcagaaacatctatttatgtcgaagcgcaaggggctaaagatcccgtcattaatttcgcccagctgactcagacagacggaacgtttcttgtcgcgagagaagatgttgaacacttcgactgggatcagctgaaaggaaaaacgtttctcggtcagcgaaaaggcggcatgccgcaaatggtcggcgagtatgtactgaacaaacataagattgacccgcgtaaggatatagacctcatccagaacatagacttcgccaatattgccaatgcgtttgcttctggaaccggtgagtatgtacagctctttgaaccgcaggcttctctctttgagaaaaaaggcatcggccatatcgtggcttcattcggagaagaatcaggagaggttccttatacgacttttatggcgaaacaaagctatttgaagaaaaatgaagacacagccgtcaagtttacaaaggccatttataaggcgcagcagtgggttgaaaatcattctgcgaaggacatcacagatgccattaaagatgaatttgatgataccgacccagacgtcatcgaaacatccattgaacgctataaaaaacagcattcatattcgccagaccctctgcttaacgaaaaagaatgggagcttctccaaaccattatggatcaatcgggagaactgccgaagcacattccatacaatcagcttgtaaataaagaaattgctgaaaaagtcacctcggagaaataggaggcgccatctatgtctttcttacatgtcgaccatgtaacccatacttatttttctattaaagaaaaaacaacggctgtgcgggatattcatttcgatgccgaaaaaggcgatttcatctcatttctcggcccaagcggctgcggaaaaacaacactgctttccattattgccggtttgattgagccatcagaaggcagagttctgattgaaggccgtgagccgaatcaaaaagaacataatattggctatatgcttcagcaggattacttatttccctggaaatctatcgaggaaaatgtgcttctcggtttaaaaatcgccgacacgctgacagaagaaagcaaagccgctgcactcggtctattgccggagttcggcctcatagatgtggagaaaaaatatccgaaagagctgtcaggcgggatgcgccagcgggctgcgcttgcaagaacacttgcgcctaaccctagtctgcttttgctggatgagccattttccgcgcttgattttcagacaaagctgtctttggaaaacctggtattccgcacattaaaggaatatcaaaaaacagcagtgcttgtcactcatgatataggggaagcgatagcgatgagcgatacgatctttttattttcaaatcagccgggcaccatccatcagatttttaccattcctaaggaattggccgcaatgttgccttttgacgcccgtcaggaaccttccttccagacactgtttcaaacgatatggaaggagctgaattctcttgagaaacagcaaagaaaccattgatctgcttcacgagcagtatcaattcaaacagaaaaaggaaaagtggaaggtccattcctttcagcttgccatatttattctctttttctcgggctgggaaacctccagcaggcagggctggatcgatccgctgatcttcagctctccatcagctgtgtggcgattattgctggagaaacttggtgacggttctttactgtcacacatcggcgtcactttatttgaaacggtgcttggctttttgcttgggacgtttatgggcacgtgcctcgccgctttgttatggtggtctaaccgacttgccagaattttagatccgtaccttgtgattttgaatgcaatgccgaaagtagccctgggcccgatcctgattgtcgcgctcggtcccagttttatcagcatcattgcgatgggagccatcatcagcgtcattatcacaaccatcgttgtctataccgccttccaggaggtcgacgaaaactatacgaaagtcatgaaaacattcggcgcaaaaaagtgggttatttttaaagaagtcatactgcctgcatcctcccccgcgattatttcaacactaaaagtgaacgtcggtttatcatgggttggcgtcattgtaggggaattcctcgtttcgaaggtcggattaggatatatgattatttacggattccaagtcttcaattttacactcgtcttcttaagcctgctgatcatcgccatcttcgccactctgatgtatcagggcgtcgagctgctggaaaagaaatggacgaaggggaggacataaaaaacccggcacatgtgccgggttttttattcaatccatccagattctttcagttttttcaaactgatcggaagtacggaatccttcataataaagctgaattttttattgcgggaaaggttctccggaagctcgtgaaacaaaaccgggcctttcgtttcaaagtaatcagcttgcttttcaagcttttctatatctgcaaaatatatatttttcacaatcactttttcttttccgagaactttatactgtccgagatacttgaggcttttgactctcgcgcccgtctcttcctttacttcccggagcgcagcctcttctgcgcactccatcggctctactttcccgcctggaaactcatagcctctgtcctcatgttctgttaaaagccatttgccgccaaaacggcaaatcacccagacatgcttcgggctgtccgagaaaggctgatcgtcaaaggaaagctgaacagtattctgataataatctttaaactcgtacatgtttatccctcaaatccgttcctagctatcttccatacatcataccacagttacgtttcttcggaagccttttatcaaaaaataagggaaacccagcacgccgtcaggttctgcatgcagactagctcgtacagtttttttgcgatagcttttgccgaaaagtgcgaccgacgctctgggctttattatgacccgcgaacagggaaaagttacggtttgcgcttaaatttattttttaacgtttctaaaagatcgacaagcatctgaggaaccggtatgccaagagaactggctgtcacaacaatttgcacagattcataaagaatataaaacataatagccaagtcacgaattgatccctctgtattcagcagctgatcaaaaaagtggcatacagagatcagagccagcgtgactaattttttgacaagccgggcaaatacctttttaaatgacagtttgtgaataatggtttccttcaaagtcgtactgataaattcaattgccataagagagagcaaaatcagaaatgaatactgaaaacctccaaagaaaaaacccgctgctgaaacgctgactgctattaacgaaaagatgccaaagtctctatccatttatcccaacatcctttcacagaaacggccttacgatattctatggaaaacaagccgaacggattggatttttcagaaaaatggactggttgtcgcctatttttcagatacaaaaagaaaagccggacgtcttttttaagacatccggccgttctttttttggacttaacctaggtaagcttttagcatccagttatgtttttcaatattttgatggatcgcaagaagcatgtcccctgttgtttcgtcaccgacttcatcagctaaatccatgccgtttttcagctcttccgcgatgactgtgaaatcatcatatacgctttgaaccatttgttcagctgtttcatttccagccgcttctttgacagaagccgtttctaaggattccttcattgttgcaatcggttttccgttcagcgccaaaagacgttctgctaagtcatcaatataagttgccgtttcgttgtacagctcctcaaacttttcatgaagagtgaagaaatcttttcctttcacataccagtgatagttatgtagtttcacatacatgaccgtccagttggctacttgtttgttcactgcttgaatcaattgttctgacatggtatctcctccttgttatatgactatgtatacccttaatatcgtacgctaaaacctcttttttacccttatctgtcacgatttcttctattatgctacaattgttaaaaaacgggaggtggaatgtcatgacgcttctcattacgataagtattttgattgtgctggctgttttgcttgtaaccatttggacgactgtaaaagcctataatgtaaagcataccattgatccaccacaagaaaatcactctgattcacacaatcaatgatgatgtgaatgttcctcttctgactgattgctggcagcatcggcgtctccgacttggacttttaaggtcggcatgctatgctgtttttttgctgtgacatgggattggacagtgtatacaccatcttccttaaacgtcgtttccaatcggtatacgcctttttcttgtttcgccttaaacatttggcttgcgtctttttccccttctttccatacttcaaactctacttcatcggcatccgtcacagcttcatcaccatatgatacggctgcttcataagcagcgctttctccgggatttactttttcaggcccggtcagcttgacatccaaaacctcgggcgtctcagctgtatttgctttgctttcaccagatccgcatccattaagcaataaagcagaaaaaagcagaacaaccaacatctttttcatgccatcaccctttcatcgtttacctaaatagtagcaaacgcttacagcaaatggtacataaaatatgagacgtcacaaaaaagacctttttgcttatgcgcaaaaaggtcctttctattttagccaaatacttttagcaattcttctttatcctgtgaaagccagaaacgcattaaacgtttagcgccttccagatcatgaagcttcgcttggccgcactgcttttcattcgcagctggtatttctgtaatctctaccgcttccttcattgtgtcttcaagtagatcaacgatttccgctgatgtcggctctccgctcacaactagataatagcctgtctggcagcccattggagaaatatcaatgatatcaaaatgatcgtatttctcagcgtgagaacgaatcgtaaacgcgagcaaatgctcgagtgtgtgaatggtgtcaggcttcatcgcctgtttatttggctggcaaaaacgaatgtcaaatttatttacaacgccgtctgttcctactttatgcacgccgcaatgtcttacatatggagcaacaaccgcattatgatcaagctcaaaactttctactgaaggcataatggcactctccccttttttaaaaatgtaatttcattataacatacttttccgataagaattattgattaacttttcaatctgtgttttttttcttatacttgcatcagaaaggttgctgaagaaacatgaaaaccctattcatcgctctgatcagaggatatcaaaaattcatctcgcccctgacaccgccaacgtgccgcttttatccgacctgttcccaatatggaatcgaagcgattaaaacacatggcgctttaaaaggcggatggctgacaatcaaacggattttgaaatgccacccgttccatccgggaggagtcgatcccgttcctgaaaagaaacaaaaacattaattgttataaccgtttacgataagatccagttttccggttttaggatcaatgactaagccatggaccggaacgttttcagggaacagcgggtgatgtttaataacgtctacgctgtctttcacactcgcttccactgaatcaaagcttttaaaccattgatcaaagtctacaccggagtactttattgtttcgatgcgttcttccggaatccctcttgctttgattttttcaagcatgcttttgctgctgattttgctcatgccgcaatcgtgatgcccgatcacacacacctcatctgcattcagctcgtacactgcgacgagtaaacttctcatgatgcttccgaatgggtgtgtcacaagcgcaccggcacttttaatgattttcacatcaccgtttcgcaaattcatcgcatgcggcagcagttcaaccagacgagtgtccatgcaagaaagaatcgccatttttttatctggaaattttgatgtttgatacttttcatactctctttgttcagtaaatgtcttgttaaattcgagaatatcatttagaagactcatgttcgttgtccctttctattctttttactcttcaatatatcacaacccttgtttattcgtcataataaaaaaagacaaaccctctggtctgccttatttccccatgttatagcgttttttgaactgctcaactcgtccgcctttttcattgaatttctggcggccagtataaaacggatgcgtgtcagagcttacttctactttaatgacaggatatgtgtttccgtcttcccactctgctgtttcattagatgttttcgtagaggtgctgagaaaacggtagccgctgttgacatcctgaaatatcactttgtggttcttcggatgaattccttctttcatgtgaatctcctttcaataaatcgtaataattacgttttattctataaccttacaaacgttttgtcaatcttcttatatccttccctctgttttcacatcgtaaacctcatggcatttaagaataggaagaataatctaaccgaggaagcaaataataaacccaaaatacatacagaacgtctttttagaaaggtggtttacgattgtggatgatttagttttggccagaagcctctttggcacgacaatgggctttcatattattttcgcaacgcttggagtcggtctcccgctcatgattttagtggcggaattgatctatcaaaaaacgaaagatgaccattatgcgatcatggcgaaaagatggacgaaagcacaagccgttttgctgggggtcgccataccgaccggaacgatcgcgggcactcagctcgcgcttttatggccgggatttatggaagtcattggccgggtgatgtccctgccatttcaaattgaaatctatgctttttttgttgaagccctattcatgtcgatttatgtatacgctgcagaccgtttgtcacctgcaatgaggattgttgctgttttctttgtgttagtcggggcagcagcatcagctgttctgattacgaatgttcacgcttttgaaggaacgcccgccggttttaaaattttaaacggaaaaattacagatgttgacccgtgggctgcgttttttaatcctagcttttttatcactgccggccatgtcgtgctgtccgcgtttatgaccggtgcatttatcgtggcttctgttgcggcgtataaaatgatccggacgaggaaaaaggaaaaggtctatcgctttcaccggaaagcccttttgctcgcactgacgatcggcggtattttttcattgctgaccgctttgaacggacacgaatctgcacagatgctgtacgaataccagcccgaaaaattagccggtgcggaaggcctgtttgaaacaagatcccacgccccgctcgctatcggcggttttaccgacccgaatgaagaaaaagtaaaatgggcaatcgagattccatgggctttaagctttttggcagcgaaccgttttgacactgttgtaaaaggattaaatgcatttccgagagatgaatggccgccgcttttcattcacacgctgtttaatgcgatggtcggtgtaggcatgctgcttattctttattctattattggtgtggtctggagaaaggtgctcaagaaagaccgtttcccaacgtggcttttggtcattttcatgacagcaggcccttttagtctcatcggcattgaattcggctggattttcgcatgtacggggaggcagccttgggtcatctatcatttgctgaaaacatcggatgtcgtaacaacgactggttcgatcggagtgctcttcttgtttttcacatttgtttatgccgtgttaggcgctgctgtcgtctacgtgctgctgtactatttccgcaagcacccggttgacgaagatttaaatacagcggagtcgtaatggctccgcaaacaggaaaccaaatggaaggagatcgacaaatggagatttcaactgacgctctgatcgccatctcaattatctggggctttgtgtttatttacgccgtcatggcgacaatggattttggagcgggattttggtctatgatctatttaaacaaggagcatatgaaggccaccgatattgcgaatcgctttttgtccccgacttgggaggtcacaaatgtctttattgtggccatcgtcgtggcgcttttcagttttttccccggcgcgacatttgtgctcggcaccgttttattaattcccggaagcatgattttactgcttttagcgattcgaagcggatttctcgtgttttcaaatacagcaaaggagcggaaaacgctaagatatatttccggcatctccggctttatcattcctgctattttaattttggtgcttcctgtgacacacggagggtttatagaaaaaacggatggaatctataacttaaatatgtctaaaatcttttcaagccccaacgcctattcatttatcgggtttgcgattttaagcaccttatttttgtcctcgctgctgcttgcagatgtttcaaatgtggcagaggaacaggatgcgtaccgagcctacagaaaaagcgccctgattaccggcccgatttcactgttgtttgcagtatgcattatggtgacaatgcggaatgaagcaaactggctgtacagcggaatgatgaatgattttacttggattattgcatcgttcattacatttgtcattgctggaatcgccctttttctgcctaataagagctttgggcaaaacatcggaaaaccgcggcttgcacttgtcgcgattgggatacagtattttctcgcaagctacgcgtacgggcgggcgcatcttccgtatatgatttatcccgatgtgacagtcatgtcaggcttcacagagccagcaacgttcagagcgctgtttgcaacgtatatcgttgcatttatcattctatttccgggcttctttttcttctggaaaatgtttatgcgagataaacgctatatccgccaggaggaatagagggcaagccagccggctatactaatccagaacctttataaggaggggatggcatggagcagaaaattctatgtgaggtcaacaactgttcttattggggcaaaggtaacaaatgcaccgctgatgccatttatgttgtcagccatactggtgaaacggctgaaaacagccgggaaacagactgcaaaacgtttaagccgcatgatttgtaattaaaagaaagagctgcatcagccagctctttctttttgcatgttgagtgttctcagctttttagttatgaccccgtttgcaggtgaaaacaaaaaggcgcttgcataacatacacctgtcatggccgccatcgctcctgaaatcgaaacattaagccacgttgcgaagaaatagcccatgaccgccgacagcccgccaatcaacgcgctgagaatcagcatataaagaagccggtctgtcagcaaatgtgccgcagccggcggaacaatcagcatggccacaaccaatacggcacccaccgaatcaaaggaagcaacagtcgtcaaggacagcatgcccatttgcacgtaatgaatgagcaaaaccggtattcccaaggctaaagccatttgaggatcaaacgaagcgattttaaactccttatagcacacactgatcaacactacgtttaaaaccagaacagatgccagcatccaaaacgctttcggcccaatatcaaccccgaataccgtcaccgtattccacggcacaaaagcgatttctcccattaacgagtgctcaatatcgagatggacattcgctccatacacagaaagcaaaataaccccgattgcaaataaggatgtaaacacaactcctatggcagcatctgattgaacccccttgctatgaagaagctgaaccaagaaagccgttaacagaccggttgcggctgcgccaataaacatataaatcccatcgagacttcccgtcactagaaaagcgccgacaatgccaagcaacactgtatgactgattgcgtcggccagcatcgccatgcttctcagtacaagaaatgtgccgatcaatccgcagcttacaccgactaatacaccggtagctataatccatgcttcaaaactcattcgcgatctgtcccttctcggcatcatgagacacttttcgaagctcaggcatccgtccatacagctttaagagtgaataaagccgctctctcgtttctctcggtaaacggtccgggtcaaagtagtcctgatcggattctatattggcaagttccatttcatgcatgagatacacttcatacatccgctgcttcaaagctgtgtgatagcctttttcaatccctttgcttgtgatttgccaaatcccattttcgatacgctcaatgcacctctcttgttccaagtcatttaatgccttaaggcataatgaaggggataggcgtcttttctttcttacactttcaacagttacacaaagatttttcttttcatactgttcataaatcgccaaaagcacttgctccctgcttgttctgcgccgcagcctcatcagccttatggctttagcagccaatccccgcttaggcgcgcaaatcattgaaaaaagaaagagcagcgttgcagataagatcattaatggccctgtcgccattcccttcatcgtggtgctaagcagggttccggccactccgctgaccccgcctgtaatcccggcaatgatgatcatcccggttaatcgttcggtccaatatctcgcggttatggcaggtgtaatcagcatagccgccattaatatcacaccaacagtctgaagcccaatgacgacagcacagacaatcagacaagccaaaagcccgtttaaaaaacgcaccgggattcctaatccctttgcaaacgcgagatcaaaagtaatcaatgtaaattccttaaagaaaacaatacataggagcagcagagcagcggatatccctgcaataaggatgatatcctgcctgaccaatgaagcagcctggccgaataaaaaagaatcaagcccgctttggcttcccgccccctgttgctgaatatatgtcagcagaatgatcccgacgccaaaaaacacagaaagaacaatcccgatcgccgagtcctcctttgtttttgaaagccgaggaatcagctgaatacaaaacgttccgagcagtccggcgagcgctgcccccagcaaaaagaaaggcagtgatttttgcccggtgaacagaaaagcgagacacactcccggcagagctgaatgggccatcgcatcgccgattaaactttgctttctcagcagcacaaagctgcccaaaacaccgcttgccgtcccgagcaaaagcgtaccggccagcacccactgtgtattcggatgctgaagctgcagccacaaactttcaaacattgcgctcactccttatgtccttctgccagcactttatcttttaaaaacgtaagccttcctccatatgttttttgcaggttttcgatcgtaaaaacgttttccgccggtccgaaagcgattttccttaaatgaagcagtaagatccaatcgaaataatcctcggcggtctgcagatcatgatggacgacaagcacggtttttcctttttctttgagctctgccaacagcgtcataatcgcgcgctccgtcgctgcatcaacacctgcaaacggttcatccataaaataaatgtcagcgttctggcagagtgcccgggcaagaaacacccgctgctgctgtccgcctgacagctggctgatttgcctcttcgcataatcatgcatcccgacttttgttaatgcggccttcgccatctccacatccgctttctttggcctctttaataaaccgattctcccgtatcttcccattaggacgacatcgagcgggcttgtggggaaatcccagtcaaccgagccgcgctgcggaacatatccgattctggtccgctgatccttatagtctttgccgtaaatagagatgtctccggaagctctgggcacaagaccgagaatcgttttgatcaaggttgattttcccgcgccgtttgggccgataatgccaataagttttccttcaggcacctgcagcgaaatgtcctgcagtacaggctttttatgataagcaaccgtcacattatcaagctcaacagggaacatatcctccacctcttttctttatttaagcgctttagtaatcgtgttgatattgtgacggaacattccttcgtatgtgccttcttttgtgcccttttcacccatggcatccgaataaagctgaccgccgattgtgactgtatggcctttttctttagcgccttccaccactgcattgattgatttttcagatacactgctttctacgaacacagcttttatttgtttttctgtcagaagatcaaccagctcctgaacatcccttaatccatagtccgaatctgtgctgagtccctgcaggccttttaccttaaatccatactcattcccaaagtacgcaaacgcatcatgagcagtcacaagcacacggcttttctccggaatatgtgcgatctccttacgcgaccacttatctaaatattgcaaatcttctttgtactctttggcatttttccgaaaggcatctgcgtgctgaggcattgctttgctgaattgcgcttcaatttcatccaccgcatagatccataacggaatgctgaaccagacgtggggatcaaacgtcttgccttcccccgcgggaataagcttatttttcggaatggcctcagctactgccgccgattgtttttgttcgccgattttttggaggacatcctccattttcccttccaaatgcaacccgctgtacagaacaacatcggcagacattaattttttcgtgtcaccttgggaagctttgtaaaggtgcggatcaacccccggtcccattaaagaggtgacttttacatgcttacctccgatgttttctgctgcatcggcaatttgagatgttgtcgctgtcacttgtaattgctgatcagcgctttttccggctgaatccgttccgcatcccgttaaagcaaaggtcgcaaaaagtactgctgccatcagcccttgtctcatatttctcctcctctttgccatcaatgtccgattgttttatcttatgttgtcagttcttagacatgtgacattaaattagccaaaagcatgttttatttacacaggacaaaaagtttcccttatgcaaaattatcgcgtttggccatttttgtcaagctgatttacataaaaaaaccggctgggtcagcagccggtccaaacgagaagggatgtattcaacgaacacttttactgtaacagcacagtgtcatttattcaaaatagcaaaatgcttttttcttaaccatgctgtgtgaaaacatccattttggtcacatattttcgcataatatcttggtttacctcaacccctaaaccaggctgttttgacacagaaataaatccattatcaatacgaatatcaggagttacaatatcttcatcccaatagcgtgaggatgaagatatatcgccaggtattgtgaattgaggcagtgaagcaagcgccacgttctgcgctcttgatatgcctgtttccagcattcctccgcaccaaacctgcatatgatgctctttgcataaatcatgaatttttaaggcttctgttaagccgccgacacgagaaggttttatattaataattttgcagcttcctagctcaatcgcccgtctcgcatcatcaactgaacaaatgctctcatcaaggcaaatggccgttttcaaatgtttctgcaagtggcggtggtcaacgatatcgtcagcttggagcggctgctcaatcatcattaaatgatagtcatcaagctcctttaaacggctgatatccttcagttcgtaagaggaattggcatcggccataagcgggatgtttgggaatcggctgcggatggccttgaccaattccacatcctgcccaggctgaattttaatttttattctttgataaccttctttttgatagctctcaatttccttcagcatatcgtcaagaggcgccaggccgactaccaccccggcagggactttatctcttgttccgcccaatgcctcagcaagggatacgcccttctttttggcataaatatcccatacagccgattcaagtcccgcttttgccatccggtttcctttataccgcgccaggctgtccggcacttctgaagggtgattgaattcacggccgacgacatttgggataaaaaaatcttttagcatatgcaaacatgttccaatggtttcctcggtgtaccaaggcgaagagaaagcggaaacttctccccagcctgtgacacctgatgtatcaatggcttccacgatcagaaatttacgctcttgaagcgtttcgatactgtttttaaacggtttctttaagttcatgctcaaatggtaaagcgtgattttttctatttcgatcatagcagttctcctttacgcgcatccttcagctgatttcgcaagagcttattagacgcattgcgcggcaggcggtcaagcacaaagaattttgccggaattttatacttcgccaagcgttctttgcagtagtcagtcaattctcctgcgctcacaggcttgtgaaggacaagataggcgtgaggcactttcccccattttttgtcctcagcccctgaaaccccggcttcggccacagcggggtgtgaaagcagtactgactccacttcggccggataaatgttttctccgccggatatgatcagatctgaacgtctgtctaatacatataaaaagccttcattgtccaaataaccaagatcacctgttttcagccagccattttgaaaggaggcttcgtttgcgctctcccggttaaaatagcttttcatgacattcgggcctttgaccatgatttcaccgtgttcatacggttcacatacctgtccgtcccgctctattttgatttcacatgaaaacagcggtttccccgcagatccgagcttttccatactgaattccggcgacagggtaacaatttgtgagcatgtttctgtcattccatatgactgaaagacagggaatcctttctcacggcattcctcaagcaatggcagaggtgcagggccgccgccgagaagaatgcatctgatggattcagggcagcggcttgtttcttccaaaagactggccagcatagtctgcaccgcagatatcattgtcacttcatgcctgttgatagaattcagcacatcgcttacggaaaaacgctggtgaagcacgacagtcattccatagatcacagatttaaataatgcggacaatccgctgatatgaaagagcggcaatgcgataagccagcggtcttgttctgttatacccaaattaagcgcggacgacaccgcactgaaatagtggtttccgaacgtttgctgaactcccttgggctttcctgtcgtacccgacgtatacatcagcgttgccgttgcatccatttgcatataagcctcgatctcaatttcctctgctgcttctttcatcagttcatccacatcaatcgtttgaacgatgtgttgatattctttcttctcaaagcttgaatctgtcaataaaaagccggatcccgaatcctccagctgaaacagcctttcatgtgttgacagcttcgtattcaaaagcaccgccttaacaccaagcaaaaaacaagcgtgaacagcgtataccatttctgcacggttttggagcaaaatagctgcagtatcccctttccgaaccgaatgagcggcaagctgttccgccattcgtttagacgcggcaaacaattctgcaaatgtcacggtttggtcttcatagatgagagcgattctctcaggtgtcagctgtgcccgctgcatgagccagttgggctgttctgtcagcatgtcatcatctccgaggtaaaatgtctgtattgaaaagaaaacagcttggaccgcaaagtctcaagctgttggtttactaggtattgctgatcacggaaaacgagggaactgtccgaaatcaggtttgcgtttttccttaaaggaatcacggccttcttttgcttcatctgttgtgtagtaaagaagggtagcatcccctgcaaactgctgaattccagcaagtccgtctgtgtccgcgttaaacgcagctttaagaaagcgcagtgcggtcgggcttttttcaagcatttcttcacaccatttaatcgtttcttcttcaagctgttccaaaggaacgactgtgttgacaagacccatgtccagtgcttcctgtgcgttgtactgacggcataggtaccagatttcacgtgcttttttatgtcctacaattcgagccaggtagccagaaccgtaacctgcatcgaagcttcccactttagggcctgtttgtccaaaaattgcgttgtccgcagcaattgtcaagtcacatacgatgtgaagcacatggcctccgccgatcgcatatccggacaccatcgcaacaaccggtttcgggatgacgcggattaaacgctgaagatccaatacgttaagacgcgggatctggtcgtctcctacatatccaccgtggccgcgcactttttggtctccgccagaacaaaatgccttgtcccctgcaccggcaagcacgataaccccaacgttttggtcgtctcttgcgtcagcaaacgcatcaatcatttcagcaaccgttttaggggtaaacgcattatgtacctcaggtcggttgattgttatttttgcaatgccattatacgtttcatacaatatctcatcgtatgtccgttttgttttccattcagccatatgatgacctccttttattctctatgtgaatgagtcagatgcttgtcaaaaactcactcactattttaccaaacaatcgcggctgttccacatggaccgtatgtcctgcttttggaacaatctctattctactagaaggaagcatcttatgcacctcttgattgatggcgcaaaatttttcgtcccactccccgcagataagaagcacaggaacatctatttcctctacacggctccacaaggaaggctgtgaaccggtgcccatgccggttaaactgttcgcaagcccaatcttattgttccgcagacggcccgatcgtatcctgtgccgaatatcttcagccagcctctgctgagatgaaaacaaagggatattctcccaatacgcaacaaacgctttgagcccgtctcgtaaaataaaatcagcaagcttccggtcccgcatgattcgttcccgccgttccccaagtgttttgagccccggcgtcgtgctttcaagcacaagtgccgatacccgctcgggatatgtcatcgcgaaagagtaagcaagccttcctcccatagaatacccaatcaatttcactttgtgaagttttaattgatcaaaaatctcggcaaggtcagaaacttgccggcttgtgctgtatcttttcccattcagcggggcatcggtttccccatgccctaaacaatcaattttgatcaaacgggaatcaggcagcatttcatcaagaaaagtccatgattgtttgctgccggtaaacccgtgcagacagacgacggcttcggaagcattcggtccctcgtctgccactgcatatcggacaccatctgataccgttatgtttacagttcccattgttttttcacttcccgcacagcctcattcagcatatcgcgatgaagctggactcttgattggcgatccgttttgatttcaatcaaatggagtccgggcttgtctgcctgcggcgcgtaagctgttttgaattcatcccaagaagccgggcatgaatacgttccgccgtaaagtgcagcggcatgcttgaaatcgagccctgtcggtgtgccgaacaaatcttcaaagtgtgtcttctcagaagcctgcggcaaaaaggagaaaatccctcccccgtcattattgacaagaatcacagtaagtggaatacccagctttttggccgccagcaagccgtttaaatcgtgataaaaagataaatctccaatcacaagggtaacaggcgcttttgttccttcacatacccccatggcagaggagacgacaccgtctatcccgtttgctccccggtttgaataaatccggaaagggcggtcctgcttttcgaaaaacgtatcaacatccctgatcggcatgctgtttcccacaaacagcgagctgttttcaggcacaagatgctgaaggattcgatagagattgccttcaaacgaaacatcttcactgctgattgtttgcagatgctcgcggaaccgcccattgacaaactgccacttttccagccactctgaggatctggcagcagcagtaaggcctcccatgatctcctcagcaaaaacagacgcattacaatgaatcatatgcgcgcttgcctgtgtcgggtctctccaccctccatcctcgtcaatcactatttgctgaatcgcaggatcatccttaagccataagaaaaccggttttgaaacaggcatcggtccaaaccgaatgacaacatcaggacgaagtttccgcttcagctcatcatcttttaaaaacgaatcatacgcatcaataacagtgcttttatcatgaacaccattccgcagattagacagcggatccgctaaaattggatactgaagcgcttttgacagcgcaataatgttttccttatccgcatcactatggagctccccgcagacgatcattcctttttcagcctctgcgagcatctcagccacatcagacagggactctcggtcaacagactgcgtacccgttttcacagacacatgacggcctgttctcattcttccaaacggctcatctgaaagatccggcatcagcggttcgcgcagcggcacattcacatggacaggccccatcgggcgcttttgtgcttctccggcagcgcggcttgccagcgttcggatgtatctcagcatttgcggagactcttcaggaagagcagagtctgtgaaaaacttaacaaagttaccgaataagaagtgctgattaatagcctgcggtgcgcctacttcgcgcagctcatgaggccgatcagcagttaacacaataataggcacccttgaataatgggcttcaaccacagccggataaaagttggccgcggctgttccagatgtacagatcaatagtacgggacgctgcttcgcttttgccaaacctaaggcaaaaaacccggcagatctttcatcaatttggacatggacgctgatatcgggatgcgcagcacaaagaacagccagcggtgtagatcttgagcccggacaaacgacggcgtccgtaattccggaaagggcgaattcatcaataaaacttccgatgtaatgagtaatcgggttgactgtcaacgcctctcacctcctaatgcagagatcatcggcttcaatttaatctgtgtttcttcatattccgagattggttccgagtcttccacaataccgcacccggcaaacagccttgcagtgcttccttcgatcagccctgaacgaatggctaccgcgaattccccgttatcctggctgtcaatccagccgataggggcagcataccagccgcgagacatcggttcaatctccctgatcacgtcaacagctttttcctgaggtgctcccccgagcgccggagtgggatgcagcttctcaattaagtcaaaaattgaagcagactcgcgcagctgtccgacaatcggcgtaaacaggtgctgaacgctttttgttttgtacaaaacaggtccatcaggcttttcaacctctgaacagcttgatacaaaagcattatgaatcatacctaccacaatatcatgctcaagcaggtttttctcatcgtttaataattcaaggcctatccggcggtcgtcttcttcattcacgcctcgtttaatggagcctgccagacaggaagacatgacagtgccgccgtctcttttgatcagtctttccggagacgcgccgacaaaggttttgccttcttgttcaattgcaaaaacatagcttgtctgctgatcgtccagaagcgttttaagcaccggttcaatttggattggaccgtcaaacgtgagcagcagctctcgggcaagaacaaccttatcatattgtttctctttaatttggcttgtggccgtttcgattgctttcagccaatcatccttatccagctcttcggctgctgcaatcacagcctgatcttcttgcttgaaatcgggaaccataaattccgccgcaaaagcttttaagccttctaaaacagcttctgcgtcttctcctccgcttacccatctgttaactgttaagaacgggccttcagcagtcatcgtcagcataagcgcaggcacaaagaaatccccttccgagaaatggtcccattgtgaacctctttcttcgcaagggtcaaaagaaaatcctccgaataacacaggtcccactgcagaatgctgcagcttttcttcttcataaatatgaaaagccgtctttttaaagcgctcccattgttcaaaaacctcacgataccgctcgctgtttttttgatttgtctggaaaaccgcttctttgccaagaccgactattgtcaattcactttcaggatctgaccaaaaaaatcgattgcctgtatatttttttgctccgtaattgaaaaatgatagagggtcaagagactcgatttgtctcgaatagcttattaagacagcatggttgacttctttggctttatgtaatgcatgtagaacttcctttcggaacgtacgctgcaccgttgtcaccatgagacattcctccataatccttaaaatgcttttaataccatacacctgtgtctcctttgtgtcaaacacagatcatgcagtccaaatggcctgccttacctattataaacctaatttcagaaatgaaaaagaaacaaagcttaaatttctttctccactgatagcaaaggttgtatccgcttaccataaaaggaaaacctcctatattcctccacccgccatttatgaaagttctcaggcgatctgttcatactaaaggtatgcatcacagagaaacgaggcgatcacattgcttacgaaagaacagcttcagcatttaaaaaatgaactggaacaaacgaaaaaagatatcttaaaccgtttcaaagacaatgaccattttcagcttaactcagcctttccttatgattcgtggggtgagctttcggcatacgacaaccatcccggcgatcaggcgacagaactttacgagcgtgagaaagacatcgctctagacttgcatgagcgagagcaccttcgggacattgagcattcattgaaggcgatagaaaacggtacgtatggcatttgtgaagtcagcggaaaggaaatccctttcgaacgacttgaagcgcttccgactgccacaaccctcgcggagtattcgtcacaggacgtggtttccaaagaccgtccgattgaagaagaaacaccattcgggcaatttgaatttgatgatgatgaagaaatcagagcgccatatgacagtgaggattcctatcaggatgtcgaaaaatatggtaactcacaaacgccgcaggatatggaaaaccctccgctcagctatgatgatatgacgatgaataccgaagagaatatcggcaatacggagtcttacgaaaatttcatcgctacagatatcactggaaaagaaattaccgtttatcaaagcagagcccatgagcgctatgaagaagaacttgacgaagagggaatcatgaccacattcggcgatctccacgctgattgaacccccaattattgggggttcttttccgttttcagcatatcgtaaatcagcttcagataatccttttgcaggccgatgtcataccgctcgccctctagcaatttcccgtatacggtacatgccccgagcgaagcttttatcgcatccgttacctgcacttctcctccgctatcagcttctaatgcctccagctcattaaaaatatccggtgtgaaaatataacgccctgctgcggcaaaatgagacggagggttttgtttaggcttttccacaatatcctgtatgcgataaagccctttttcaacaggctccccttttatcaccccgtaatgatgtaaatcctccgtttttgtttcttttaagccgatcacactggactgatatttcgtatacgcttcaatcagctgccccaaagccggctgattggcggaaaaaatcagatcatctggcaaaacgacggcaaaaggctctccgcctgcaaattgctttccgaaagaaatggcgtcgccaagaccctttgcataaggctgccgcacatagtgaatccgtatatccggaatgggatgctctctaagtaaatgcagtttattcttagaggccaaaaaagcctcaagtgccaaagaggaatcaaaatagtcgacaatcagatttttatggctcgatacaaccatcaaaatgtcctcaatgcctgactcctttaattcttcaacaagataatgaatcacaggcttagatcctaccggaaacatttctttcggaatcaccttcgtcaccggcagatttctcgtgccgaatccgcctgcaggaataatcgctttttttatcatggtattttcccctcagctcatgtttattacatgatattccaagagcgcatcccgatgtttgtacatctgaaattaggcggaagcaactgggcagaaagcggaatcacgaaccagcccttttttaataggatattgatatatgaccagtaatcttgtaaaggagctcaggtgatgaaaatttgtgtggttggcgccgggtatgtcggtttaaccctatcagcggcactggcatccatcggacatgacatgatatgcacagacaaagacgtcaaaaaaatcgggcagctgaaaaaaggagtcattcccttttacgagcctgggctttcagatgcaatacttcgttgcggcaatctctcgttttcttctgaagtgaaatcgagcatggaggaatgtcccgttatttttatcgcagtcggaactccgccgcgttcggacggatcagctgatacgaaagccctgcagtccgtcatcggtgatttaagcgaggcgatccgatcgtataaaaccattattacgaaaagcactgttccgcccgggacaaatgaaaacatagcaaaacagctgattgcctccggagtgtctaaaaacctctttaatatcgtatccaatccggagtttctgcgggaaggcaatgccttatatgacatgctgcatcctgacaaaacagtcatcggtgttcaggaagaagatcacgtatcggcagccatcgtcaaatccatttacaaacacattgataccccttttatcgttacaagcttagcgggagcagagctgatcaaatatgccaacaatttctttttagcggccaaaatttcgtttattaacgaaatggcccgcatatgtgaagcctatcaatcagatatctcagatatttcccgcgctatcggtctagacccaaggatcgggaagcactttttgcaggcaggcatcggatacggaggctcttgttttccaaaggatctgcaggcgctgcaatttgctgcccaggaaaaaaacacggagaccttcctgctccgggccgtgcagcacattaatgacacccagctcggcctgtatatcaaaaaaatacagtcattcttcgaaacacttcaaggcaagaaagcggctgtactcggcatttccttcaaaccgaatactgatgacatcaggaattctcaggctgtcagactgatggaaaggctggcggagctgggatgtgatgttcatgcatatgatcctgaagctgtacttccagaacatttgcggaagcatgtaactcagcattctcaagcttttgatgcgatcgaagaaagcgactttttatttttggcgacagaatggcccgagtttttagcgtttgattggaaaaaggctgcagatatcatgaaagggcgtcttgtgatagacgggcgcaacgtactgaaaaaagaactgatcgagacttgcggcctgatctgtacgggagttggccgtccatgaaaatactcgtcacaggagcagctggctttatcggctcccacctctgcgaagaattactaaaagataagaaacataacgttatcggaatcgatgactttatcggtcctactccattttccttgaaattaaaaaaccttaaaaacctgctgccggaaaagcgatttacgttcataaaggaaaatctgctgacagccgatcttgctcccttactggaaggagtggacgtcatctttcatttggcggccataccgggtgtccgctcaagctggggcaatcattttcacccatatgccgcacataatatccaggcgctccaaaggctcctcgaggcgtgccgggaacattctattcaaacgttcgtctttgcatccacctcttccgtctatggcgaaaaacaaggaaaagtcagcgaaaacacgtcgctttctcctttatctccgtacggggtaacaaagcttacgggagaaaagctttgccatgtgtatcaacagagctttggtattccaattgtgattctccgtttttttaccgtatacgggccaagacagcggccggatatggcttttcaccggctcattaagcagcaccttcagcaaaagccgcttaccattttcggtgatgggcagcagtcaagagatttcacttatatcggcgactgtgtcaaaggcatcaccgctgttcttgggaaaccccaccttattggtgaaacagtaaatatcggcggcgcagagcgtgcctcagtcttaaaggttgtctccctcattgaggatatttccggtagaaaagcaacactgcacttttcggacaaaatagcaggggaaccgagcaacacgtgggcggatatttcaaaagcaaaacagctcttgcattatgatcccgccacatccttaaaggatggcttgaccaacgaaatcgcctatttatcgtcgctgtatcagggggaataaaaatgaagcttgcctttatctgtacagaaaagctgccggcgcccgcagtacgcggcggcgctattcaaatgatgattgacggtgtcacgccctatttcagcagcaggtacaacctgaccattttttcaatagaagatccatcgctcccaaaaagagaaacaaaagacggcgtacattatatccatctgccaaaagaacattaccgcgaggcggtagccgaagagctgcgagcctcttcctttgacctcattcatgtgttcaacaggcctttaaatgtctctttatataaaaaagcctcaccaaacagcaagatcgttctgagcctgcataacgaaatgttttctgaaaaaaagatgaccttcgcgcaaggaaaagaagtactcgacaatgtctccatgatcacaacagtgagcgaatttattaaacaaaccgtcattgaacgtttccctgaagccgaggacatcacaaaagttgtgtattccggcgttgatttaaactcttatccgcccgtatggacgatgaaaggctcggctgtcagaaaaacataccggaaaaaatacggtattgaagataaaaaagttattttattcgccggccgcttaagcccgataaaaggacctcaccttctcattcacagcatgagaaggattttgcagcagcaccctgatgctgtactggtcatagcgggcgggaaatggttcagcgatgacagcgaaaaccaatatgtaacctatctgcgcacgctggcgctgccatacagagaccacataatctttacaaaattcattcccgcagacgacatcccaaacctttttctgatggcagatgtatttgtgtgcagctctcagtggaacgaacccctcgcccgtgtgaattatgaagcaatggcggccggcacgcccttaattaccacaaatcggggcggaaacggagaagtcgtaaaagacgaagtcaccggccttgtcatcgacagctacaacaaaccttcttcatttgcaaaagcaattgacagagcctttacagatcaagaattaatgaacaaaatgacaaaaagcgcccgaaagcatgtagaagctttatttacctttacccatgctgccaaaaggctcaatactgtttaccaatccgttctgaccccgaaaaacaaacaatttccgccgccttttctgacgcaaaattttgatttatcatctatcaatcagctttttgtgaaagcaaaaacataaaacctacagctcgtgttgcaaaacgggctgtttttttgctgcagaaaacataaaaaaaggcataaatgtgactttatgccttgcgctttacggtttgagaaaaccatggagctggtttagattcacttggaagaatgatgatttccactttagcttcttccgctaagtctggttcttcatcttcatcctcttcttcatatggggacactgagcgtttcgaatcacgctcctcctcaggctctagaatggtttcgaatttcgtttcttcttcatcatcgacgattttgtgatctgtttccttttccttcgtttcttcttgatattctttcggtgcattgatgtgagggagctctcgaatgctgcccacatctaaatgcttctcctcttcttccttctcagctgacattgagtcatgagcctgccaccccatcggcccaggcggtgtaaatacgaattggtcgagatccagtttagaaatagaggctttttgtctcgatgacctcatgtcaattcgcctcccgatacgcttttatctttttatacagttccggcagtttatccaaaaacgaatctttagattcttcaacagaaatcatgttttgcagcgcccagttatatttctcatctgaccacgttttcttttgcttcaaataatatttgtgcccgattgcacagaacaaatgcggaaacgcgagatcaatccaaagtacctcgtactgtttttctgtgagcggatacactgcgtcgtaggccgcaagcagtgcgaccatgaaatcagtatcccatacagaaagcttaaccatcactttattcagcagaatacgaaggtctcttgacggcaaatcgtaggtaatcgagtgaagctcctttaaaaaaggctccccttcgatctctgtcaaacgtgccaatgtaaaatcttgaaaacagaatccgccatgctcgagcgtttcttttgtccaggtttcgtattctgagtcatcaagcgcctgaagagcttcttttcctcttgccagcattttatcagcatgttttaagaaagtttgcgaaaatacgtcatcaggataggatgccgcgatctgcatattcccttcaagttcctgcagcttccatcggtacaatttatgccattttcccagcctgcttctcttcttgctttcatctgtgcaaacatatccttttgaggcatgatgaaaatggccggcaaatgacatgacttttttcatttgctctgcatcatagtaaatcatttcttttcctgtcactttgtcatataagctgtaagaaacctgatccgtgcccaagcagctcccgccattttttgtttgatgaatcggcgctatcggcagccctttctcttgtaaatgagcgtgtgcctgagtgataaaaagcatccgctccggtttcatttgcgcttcttttagcagctttgggccatgatcagtttcgacttcccagattttgcgcccgcttttgttcgatttcagcgccacatggtcgatatgaaacggataatagctgagaatttcggacacaatctgttcttcatgctctttttggtacactctgttcaccccttctatctgttcttttcatagacgctgagcagattttcagccaccctctgccagccaaaattgctttctgcctcacggcggctgtatttcccaagccgttcccgcttttcagagctgctcagcaaatcattgatacgttcggcatattgtttaggattttcaaagtcatgaatgatgtagccgtttttcccttcctctatgacctctggattgcctccccgattgcttgtgataattggaagtcccgcagccatcgcttcataatgcacccttgctaaaggctcctgccattgcgaagagcatacaaatacatctgacatggtataaaggcgcggaatgtcctttggcttcacaaattgaataaatgtgacatgatccttttgcatcgcaccaagggtatgaagatgtttgacatagttatttaattcattatctccgaaccattttgacccgataaacaccatcatgacatcggggtgctcctcaatgatgtccggcaaagcctgcaataatatgtgcgggcctttgactttgctaagccggccgacaaacaagacgatttttttgccgtgaagccccagctcgcttcgcatctcttcgcgagctcgctgcccttcattcgtccagcgagggtggtacgtttttaaatccacaccagaatacaccgtttttgtttttgatcgtgctgacggaaaacggcttgtgatcgtctgtccgatataatcgctgaccgtaacaatctgcgctacggagtcgatgcaaatctcgccttccgcctggctgattttatcgtaagcgaacatttcattgtgaacgcttaaaataaaaacagcatccggcgcctgtttcttcaatttcggaacccagcttgggcgattacaaacatgcacaagatcaaaacggctctttttcagctctgctccaacggcttcttcataacggtcttcatccaaatgcacataatggacaccgtctaccttctctctatcagcgagattcggatctttaatagaaaacacagtcacctcatgtttttttgcaattaaaggggcaaccgcttcgaggtagatttgaatggcgcctcctcgaaccgatgggacaggaagcttctctgtggcgatcagtgctattttcatacatagcctccattcctgcatgatttttaactagttagaatcatgatacggctgaacaaccaacttgtgcggaatgggactgccctaaaaacaaaacgggtaaacaaccagattcatctattaaatatagtcaaataactcaatcattttttccttttgattcataaggtaggagtaaaacaggtaaggatgtgtcctttaatggcagaaaaccatgaagtcattgaggaggggaattcatcagagcttcctttatcagcagaagatgcaaaaaaattaacggagctggctgaaaatgtgcttcaaggatgggatgtgcaggctgaaaaaatagacgtcattcagggaaaccagatggcgcttgtctggaaggtccacacagactccggcgcggtttgtctaaaacgaatacacaggccagaaaagaaagcgttgttttccattttcgcgcaggactatttagcaaaaaaaggcatgaatgttcctggcatactcccaaacaaaaaaggcagcctatattctaagcacggctcatttctatttgtcgtatatgactggatcgaaggaagaccgtttgagctgactgtaaagcaggacttggagtttatcatgaaaggccttgctgattttcatacagcttccgtcggatatcagccgccaaatggcgttcccatatttaccaaattaggtcgctggccgaatcactacacgaaacgatgcaaacagatggaaacgtggaagctgatggcggaggcggaaaaagaagatcctttctcacagctttatcttcaggagatagatggctttattgaagacgggctgcgcatcaaagaccggcttttgcaatcgacctatgttccatggactgaacagctgaaaaaaagccctaacctttgccaccaggattacggaaccgggaatacactcttaggagaaaatgaacagatttgggtcatcgacttagataccgtatcatttgatctgcctattcgcgatttgcgcaaaatgattattccgcttttggatacgacgggtgtttgggatgacgaaacatttcatgtcatgctgaacgcatacgaatccagagccccattaactgaagaacaaaaacaagtcatgtttattgatatgctgtttccttacgagctttacgatgtcattcgcgaaaaatacgtccgcaagtctgctttaccgaaggaagaattagaatcagcttttgaatatgaacgcattaaagcaaacgcattgcggcagcttatttaagaccatcatttcccccgcatatcgggggtttgatctttataagataaagggtaattaaatacatgcggaggttgcaaatatgaaaaagattgtcggcgctttagccgtttttgtgattacatatgcgctgttttcagccgcaggctacctgtttcctgtggaccaagaatggtacaattcattgaaaaaaccggactggacgccaagcggaactgcgatcggcatcatttgggccatcctgtttgccctgatctccctttcagcagccattgtatatgctgcgttttcatttaaaggtgcgaaaagcttttggtttacacttttgataaattacgtgctcaatcaagccttcagctatttccagtttacgcaaaaaaatctgctggctgcatcgcttgactgcctgcttgtcgccatcacagcaatcgtattactgatcattgccaaaaaatacagcagagccgcaagctatcttcttttgccttattttttatggagtgcatttgcgacgttcttatcctttacaatcaattcaatggatctgtgaacaaaaaaagccgcttatacagcggctttttcacatcatcggcttgatgccccaaatgtccttcgcatattcccggatcgtgcggtcgctggagaaatatcctgaatgagcaatgtttacaatcgaacgctcagaccatttccttcgctctcgataatcagcttgaattcgctcctgcgcatctgcatatgagctgaaatccttcagcacaaaatactcatcattatgcggaagcagcgagtcaaagatcgattcaaattcatctgcttctccttcaaaaaaaccattgatcagctgatccgctacctgcctgattcttctgtcatgctgataatattccctcgatctatagccaccattttcctgatacgatagaacctcatccgcctttaagccgaacgtgtaaatacagtcagggcccacccgctcaaagatctcgatatttgcgccgtcatgcgtgccgatcgtcaaagccccgttcatcataaacttcatattccctgtaccagacgcttccttgcttgcagttgaaatttgctcacttacgtctgatgccggaaaaattcgctcagccatagaaactctataattttctaaaaaaacaactttgatcagctgtttgactgccggatcataattgactttttctgcgacagaatggatcagcttaatgattttcttggcataataatagcttggtgaagcctttgccccgaaaataaaggtttgcgggtagattgaaaacccggcgtcctccttgaggcggttatacaaatacataatgtgaagaacattcagcagctgccgtttatatgcatgaagccgtttcacctgtacgtcgaatatgctgtcagggttcacaaccaccccggccgtgcaaaaaatcaaatcggcaagctcttgttttttcttgcttttgttgttttgaaactgttcaataaatgcaggatcagtggcgtacggttctaaacggatcagtgattccggctgtttgacccattcatcgccgatcgcctctgtaatgatggcagacaagcctggattcgcttttaacagccagcgcctgtgggcaattccattcgtcttattgttaaaacgattcggaaacagcaagtgaaagtcgcgcatctccctttccattaatatatcggaatgtatttttgcaacgccatttacactgtaactgcctactatggccagatgagccattttgacaacaccatgcgctgtaatcgccatgtcctctatccttttccagtctcccggatacttttcccaaactgcgcggcaaaacctctcattgatctcttcaataatcatgtacattcgcgggagcagcggcttaaacaaatgaatcggccatttctcgagcgcttctgacaatgttgtatgatttgtataagaaatcgtatgtacagtgatatgccaagcttcttcccagctcatgttctcttcatcgagcaaaatccgcatcagctcaggcaccgcaagcgcagggtgagtgtcattaatatgaatgctcacttttttatgcaggccggataaagatttatgtgtttttcggtaattgttcacaatgctttttaagcttgcgcatactaaaaaatactgctgcttcagccgtaaaattttcccctcatcatgggtgtcatcgggatataagaattcagaaaccgcctctgtttcccgcttataagacaaaatattaccgccgtgataatgcgcatagggctcggcgttccagagccttaacgtgttgacagtgcccgtttcatagccgatgaccgggatatcataaggaacagcggtaacaattgtcgcttgttcgtggcgaaaatgcaggcgcccgcttttttctgtcatatggacttcgccccaaaacggcacgtccactgcttgatccgcattccttacttcccatacgttcccgtttttcagccattgctcaggcagctccacctgatgcccgtctacaattttttgctcaaacaaaccatgcttataacgtatgcccatgccgtgcccaggcaggttcaacgaagcaagcgaatctaaaaagcaagcggccaagcgcccaagtccgccattgccgagacctgcatcgttctctatctgaaggatctcctctaaattgatgccgatttcctttaaaccagcttctacaacatcacgaacaccaagattcattaagttttgctcaaggagctgaccgagcagaaattcgattgataaataatatgtctgcttcccggaatttgatctgcttttttcattcgtttcgatccaatcagcgctgatatactctctgaccatattgcccaacgttttatattgatccagcttggcagaatctttaaagctttttccgcacgtcatttccagacgctttaaaaataagtctgcaaagcgttctttactcgagaacatcccgtccactccttgtcacctgctcgaaaatacgctgatactctttagccgacttcccccagctgtaatctgcattcatagcggtcttcacgatgctcttccatacatcctgttggcaataaaacgacagcgccctttctatcgtaaatttcagatcatgcgcattaaaggcggaaaacgtaaagccattgcccgttccctcttcctcctgataggcacggacagtgtcgtaaagaccgcccgtttccctgacaatcggaatggcgccatattgaagagcaatgagctgccccaaaccgcacggctcaaatttcgacggcatcaaaaacatatcagagcccgcataaatttgatgggctagcggctcatcaaacccgatataagcccggcacttctcatgaaaagcaaattctgcataccggaaataatcttcaaattcacgttctcctgtgcctagcacaaccagctgtatgtcttgctcctcaagaagttcgtgcataattctgcggacaagatcaagccccttttgtttagtgagccttgtcaccatactgatcagcggaatatcgtttttctctggaagccccatccgctgctgaagcttcgttttgttttccagcttgcatgcaagatcccctgaatcgtattgcgcctctatataagggtcgcttttcggctgatagaacgtatcatcaatgccatttaatatgccggttacatcatcttccctatattgcaaaacctgttccaactgctcaccataatacggcgtcatgatttcatttctgtaagtggggctcacagttgtcacatgatcagccgcaatgatgcccgctttcataaaattaacaaatccgttgcattctaacctttcataatgaaaatgatccatctcaagacccagcaagtcatgtgtgacatcaggagggaatatgccttgaaactgcaggttgtggatcgtgagcacgcttttcatccgttcataaaaaggatgttttctgtactcctctttcagcaaataattgaccatcgctgtatgccaatcgtgagtatgaacaatatcggctggaacattcacaactttggcagcctccagcacagctcttgaaaaaaaggcaaaccgctcaccgtcatcataatgcccgtacaacgaatccctgttgaaatagtactcattgtcgatgaagtaataattcacatcgtcttcggccatatgttcaattccgcaatattgctgacgccagccgacagctaccgtacactcagccttttttttcatacgctttttccacggttcaggtatttggctgtacttcggcagcatcacatatacttcattgcctaatcgcgcaagcgccttcggaagagcgcctgctacatcggcaagacctcctgatttcacaaatggggtgcattcagacacagcaaataatatcttcaagaattcatcagctctccttgcaccaaaccttttcttaatacaagcggctgctcagctgttcctacagcttccgtcgccttgccgattttaacgtccttatccgaaatgacctgctcaagaagacaatcctcgccaatctgcgttttttgcataataatacagtttttcagcttcgtaccctttccgacatggaccgccctgaacaaaatgcagttttcaacctctccttcaagcacacagccgtttgccaccaaagaatttttgacagtgctgtgctttccgtatttcgtaggcggctcatccttcacttttgtatagataggctgctgcggcaaaaacacctgctgccaaaaacgaggctgaatgagctccatactgtgggtataatatttttccaccgaatcaatgacagcagcataacctgaatattcataagggcaaatggtcagggcggaagattccttttcaacagcctcctgaatggttttatagcctttttcgctatgtccgtagatcagatcctttaaaagcgttgttgacatgatatagatttgcagcgactggccgtcctgaaatacctcggtgacgtcgcagccaacctcctgatggcgtttcagcacatattgaaattgaatgttgcatacggtatggctgttggagattacagcatattgctgagtgcttctgtggaagtaatctagatggtccgaaaactggcgaaaggaaccgaattcatcgtattcgtgatgaagatggggagacgggaaaaaaaagaggccgtcctttttccggtgcaaatcccattccttacccgccccaaggtgatccatgagcgaacggtaacgatacttcggaaaaattgcaacactcctaatatccgcattcaccatgttggaaagcataaaatcaatcagtcggtacctgccggcaaaagggatcgccccgagcgaccgctttgctgttaaatcctgaagagaatgcttatatgtggtttcatctataacacctaacatttgattattgaacactgactctgccccctcttcagtaattaaatcaattctttttctacaaattcctctgaaacgagcagcacctcttcaatgtctttttcggagcgaatcactgcgccatccggcagcaccatcccattaggaacaatggcattttcaatgactacatgctccccaatcgtcacatccggcattatgacggatgatgtaacagtcgtatgcttaccaacagtcacaccttgaaaaagaacggagtgagacacatttccatatacaacacaaccttcgttcacaagcgaatcttgaacctgcgcatcagatgaaataaattgcggaggctgatttggattgacggagtaaattttccatttgcgttcaaacagcttcagctccgagtcctcttttaacaaatccatattggcttcccacaagctctgcaccgttccgacatccttccaatatcccttgaacggataagcagaaagcttctttttctcttccaaaagcagaggaataatgtctttgccgaagtcgtggctagaataagggttttgatcgtccatctcaagatactgtttcaaaagcggccaattgaatatataaattcccattgaggcaagattgctcttagggaatttgggcttttcatcaaaatgtgtgatcgtcccatctggattggccttcatgatgccgaaccggcttgcttcctccaagcccacttcgatgacagagatggtcacatctgctttcttttcaatgtgataatcaagcattttgccgtagtccattttgtatatgtgatctcctgataaaatcagtacatactcaggatcatactgattcaaataattgagattttcataaatggcgcttgccgtccctttataccacttgacttctgatgactcggcataagggggtaaaaccgtcacgccaccattatatctatccaggtcccatgcactgccgatcccaatataggaattcagctcaagcggctgatattgcgttaaaatcccgactgtgtctatgcctgaatttgaacagttgcttagggtaaaatcaataatcctgtatttacccccgaaagatacagccggtttagccatattttttgttaatccgctgagacggctgcccttcccgccggcaaggagcatggctacacattgttttttcatctttttatctctcctctttttttaaccgcccgtaaaatcgagatgccgtaaggggggatggtcatcgtgatataacacggtttatgatgaagtgctccctttttagccgataatggctttttgttgatttgccctgagcctccatatgtttcactgtcactgttaagcacttcaatgtattgagtaaaaaaaggaactccaacatcatattgatgatagaccacgggtgtaaaattacaaatgatgacaagcgcctcaccgtgctttttgccataacgaataaaagaaaagattgattgttcgtcattatggacatcaatccattcaaacgattgtgcacgatggtcatgctcataaaggattttgcttttttggtaaaagcggagaagatcttgcgtaaaaacgctggctttctgatgcatggggaaggagtccaaaaaccaatcaagctgttctgtatctttccattcatcaaattgggcaaactctgatcccataaagatcaatttctttccgggatgcactgtcatatagcccagcaaaagccgatactgggcaaatttctgccagtagtcgccaggcattttattaagaagtgatttttttccgtatacgacttcatcatgagaaaacggcaatacaaaatgttcactaaacgcatatagtaatgaaaaagagataagctgatgacaatgccgcctttcttcgggcggcgtctccatgtatttcagtacgtcattcatccatcccatattccatttataatgaaaaccaagccccccttcctcaacggcacctgtcacttgaggccattctgtagaatcttccgcaatcatcatcacatggggatatgcctctctcatggtttgattgagtttttttaaaaactcaacagcatatggattcgtgtggcgttcatcctgatttggccaatacaagatattagccactgcatcaaccctaaatccatctatatgatagaattccgcccagtacaacgcattcgaaattaaaaaactatgaacttccggttttcccaggtcaaagtttgccgtgccccataaccagttctcccgatcacgttcttctttgtattcataaagcggttctccatcaaacatatagagtccatgtgcatctttacaaaaatgtccggggacccaatccaaaatgactccgatattttgttgatgacattcatcaacaaacttcatcagatcatgcggcgggccaaacctgcttgtcgggctgtaataccccgttccttggtacccccatgaacgatcatatggatgctcatacaccggaagcagttcaacatgggtaaacccatgctccttgatataagggataagcgtctgacttaattctttataggaataatgcctgccatcagaatgcttcttccaagacccaagatgcagttcataaatgaaaacaggtttttcatacagcgtcttagtcttctgtttcttttgccatttttgatcttgccagctgtacccttccaaatcgtaagtaagtgacgctgtgtttggtctgacttctgaataaatagcgtatggatctgccttcagcctgatctcaccgttattcgtcacgatttcatatttatatcgttccttttctcctaaacctggaataaataacgtccaaataccactatcattcactctgtgcatcacatgctcttctccagaccagctgttaaaatctccagccactcgtacttccgacgcatgaggcgcccacacacagaattcatatccgcttttgccattcagctcgcggtaatgcgagccaaacagctgatagctttcaaacagactgccttcgtgaaaaagataaacatcatgtgctgtcgggctggcagcggccatgtaatcatcctttctgacatcatagttttcatttatagtatttattcgaagaaataaaaaaaagccctttgctgaaagcgcttatacttatagacaattaacttcattttctgaagaaaaacgaaatatatggagatttttgtagtctgcttttaaaataaagaacaaaatctaagacatatcatgatttagaaaacaaaaaaaccttgcaggatatgcaaggcttctggatgacccgtacgggattcgaacccgtgttaccgccgtgaaagggcggtgtcttaaccgcttgaccaacgggccgataattattatacctgtaatcatatggcggagaaggagggatttgaaccctcgcgccgcttacacgacctacacccttagcaggggcgcctcttcagccacttgagtacttctccatttggctccacaggcaggattcgaacctgcgaccgatcggttaacagccgatagctctaccactgagctactgtggaatacaaaagtcatggtgggcctgaatggactcgaaccatcgacctcacgcttatcaggcgtgcgctctaaccagctgagctacaggcccatgacgatatagaaatggagcgggtgatgggaatcgaacccacgacatcagcttggaaggctgaggttttaccactaaactacacccgcaatttttatttggggcgattgatgggaatcgaacccacgaatgccagagccacaatctggtgcgttaaccacttcgccacaaccgccaaaatatattgataaatggtggctcgggacggaatcgaaccgccgacacacggattttcagtccgttgctctaccaactgagctaccgagcctaagtatttaaatggcggtccggacgggactcgaacccgcgacctcctgcgtgacaggcaggcattctaaccaactgaactaccggaccattttaaaatttggttgcgggggcaggatttgaacctgcgaccttcgggttatgagcccgacgagctaccgaactgctccaccccgcgatgattaggaatatgtatggcggaggaagagggattcgaacccccgcgggctttgacacccctgtcggttttcaagaccgatcccttcagccagacttgggtattcctccgtatagtggtggaccttgtaggactcgaacctacgaccggacggttatgagccgtctgctctaaccaactgagctaaaggtccattggtagcggcggaggggatcgaacccccgacctcacgggtatgaaccgtacgctctagccagctgagctacaccgccaaatatttttagaaatcaagtggagcctagcgggatcgaaccgctgacctcctgcgtgcaaagcaggcgctctcccagctgagctaaggccccaagaatggtcgggaagacaggattcgaacctgcgaccccatggtcccaaaccatgtgctctaccaagctgagctacttcccgatttcatatagatcatggcgcgcccgagaggagtcgaacccctaaccttttgatccgtagtcaaacgctctatccaattgagctacgggcgcaaaacttaatgccgagggccggacttgaaccggcacggtagtcacctaccgcaggattttaagtcctgtgtgtctgccaattccaccaccccggcgtggatggtatagttggagcggaagacgggattcgaacccgcgacccccaccttggcaaggtggtgttctaccactgaactacttccgcagaaatggtgcggatgaagggacttgaacccccacgtctgtaaagacactagagcctgattctagcgcgtctgccaattccgccacatccgcaacatgtaaatggtgagccatgaaggactcgaaccttcgaccctctgattaaaagtcagatgctctaccaactgagctaatggctcttcttacaagagacttgaatattatatcatataaaagtggtgccggcaagaggacttgaacccccaacctactgattacaagtcagttgctctaccaattgagctacaccggcatatatgtaaaaccgatatgtataatgaaaaatggtggaggatgacgggctcgaaccgccgaccctctgcttgtaaggcagatgctctcccagctgagctaatcctccatacttgcactaacgtgcaattgcttggcggcgtcctactctcacagggggacccccccgactaccatcggcgctgaagagcttaacttccgtgttcggtatgggaacgggtgtgacctcttcgctatcgccaccaaacaaattgagagtgttctctcaaaactagataacaggtgtgacatcattcaaaaatatggttaagtcctcgatcgattagtatctgtcagctccatgtgtcgccacacttccacctcagacctatcaacctgatcatctttcagggatcttacttccttgcggaatgggaaatctcatcttgagggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccggggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttaccttttaggaggcgaccgccccagtcaaactgcccacctgacactgtctccccgcccgataagggcggcgggttagaaggtcaatacagccagggtagtatcccaccgatgcctccaccgaagctggcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggctctctcgggcttgcaccctaacagagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactatatttcgctcgccatcacagctcagccttatgggaaacggatttgcctatttcccagcctaactgcttggacgcggatatccaataccgcgcttaccctatcctcctgcgtccccccattgctcaaatggtgaggaggtggtacaggaatatcaacctgttgtccatcgcctacgcctttcggcctcggcttaggtcccgactaaccctgagcggacgagccttcctcaggaaaccttaggcattcggtggaggggattctcacccctctttcgctactcataccggcattctcacttctaagcgctccaccagtccttccggtctggcttcacagcccttagaacgctctcctaccactgttcgaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtcattggcattcggagtttgactgaattcggtaacccggtaggggcccctagtccaatcagtgctctacctccaagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacgaccacgtactcatgcgccctattcagactcgctttcgctgcggctccgcatcttctgcttaaccttgcacgggatcgtaactcgccggttcattctacaaaaggcacgccatcacccgttaacgggctctgactacttgtaggcacacggtttcaggatctctttcactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcctttgtaactccgtacagagtgtcctacaaccccaagaggcaagcctcttggtttgggctaatcccgtttcgctcgccgctactcagggaatcgcatttgctttctcttcctccgggtacttagatgtttcagttccccgggtctgccttctcatatcctatgaattcagatatggataccactccattacgagtggtgggtttccccattcggaaatctccggatcaaagcttgcttacagctccccgaagcatatcggtgttcgtcccgtccttcatcggctcctagtgccaaggcatccaccgtgcgccctttctaacttaaccgttaaaaagaatcactatgtgatatcttgtattactaattgaatgtgatgtctactgttatctagttttcaaagaacacgtttcgaaggaatgatccttcaaaactaaacaagacagggaacgttctgtttataagacccaaggtcttatattccgtataatatccttagaaaggaggtgatccagccgcaccttccgatacggctaccttgttacgacttcaccccaatcatctgtcccaccttcggcggctggctcctaaaaggttacctcaccgacttcgggtgttacaaactctcgtggtgtgacgggcggtgtgtacaaggcccgggaacgtattcaccgcggcatgctgatccgcgattactagcgattccagcttcacgcagtcgagttgcagactgcgatccgaactgagaacagatttgtgggattggcttaacctcgcggtttcgctgccctttgttctgtccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgtcactctgcccccgaaggggacgtcctatctctaggattgtcagaggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgttagctgcagcactaagggcggaaaccccctaacacttagcactcatcgtttacggcgtggactaccagggtatctaatcctgttcgctccccacgctttcgctcctcagcgtcagttacagaccagagagtcgccttcgccactggtgttcctccacatctctacgcatttcaccgctacacgtggaattccactctcctcttctgcactcaagttccccagtttccaatgaccctccccggttgagccgggggctttcacatcagacttaagaaaccgcctgcgagccctttacgcccaataattccggacaacgcttgccacctacgtattaccgcggctgctggcacgtagttagccgtggctttctggttaggtaccgtcaaggtaccgccctattcgaacggtacttgttcttccctaacaacagagctttacgatccgaaaaccttcatcactcacgcggcgttgctccgtcagactttcgtccattgcggaagattccctactgctgcctcccgtaggagtctgggccgtgtctcagtcccagtgtggccgatcaccctctcaggtcggctacgcatcgttgccttggtgagccgttacctcaccaactagctaatgcgccgcgggtccatctgtaagtggtagccgaagccaccttttatgtttgaaccatgcggttcaaacaaccatccggtattagccccggtttcccggagttatcccagtcttacaggcaggttacccacgtgttactcacccgtccgccgctaacatcagggagcaagctcccatctgtccgctcgacttgcatgtattaggcacgccgccagcgttcgtcctgagccaggatcaaactctccgataaatggatcacaggttaagttcaccgcatcctgcggcgacacctgtgtgacctgcgtcgtgcagaccctagtttgactgactacgcacatcgctgtgcgatttttaaaaactgaattaacaggtacgttttgtcttgtttagttttcaaagatcatttcgttacttctcaatgaagcagctttactaatataacattcagcttcttttttgtcaacaacttttttcaagttgttttgaagcatctagtttgtgtccgctgtgcatcagcgacgtttaataatataacacctgtatttatttattgcaatagtttttttaaaaaaatctataaaacaaataaactataatcctcgccatgatttctaaagcgtgtgtatcatataagtttcttaaaagaacatatacatcagtcatgtgatcttgttgtttttttcgttttcttgtatagtagaaacgaactaaatactgatgaccacaaggggagcattaaagctgagagtgagcggtttcgttctgaccctttgaacctgttagttaacgctggcgtagggatgtggcaaagtcaaatgaattgcagatcgtaaagcagtgcgtggaacttttctcatccttccgcgtgctgcttttttgttgtccttttggttgtctgtcaatggaaggagatagatatgaatcaatctaagcaactggttcgccttattgaaattgccattatgacagcggcagccgttattttagacattgtctcaggaatgtttcttagcatgcctcaaggaggctcggtctccatcatgatgattccgatctttttaatttcgtttcgctggggtgtcaaagcaggtcttactacaggtttgttgacaggtctagtacaaatagcaatcggaaacttgtttgctcaacatcctgtacagctattgttagattacattgtcgctttcgcagcaatcggcataagcggctgtttcgcttcttctgtccgtaaagccgctgtatcaaaaacaaaagggaaattgattgtttcagtggtcagcgcagtttttatcggcagtttgctgcgctatgccgcgcatgtcatttcaggagctgtgtttttcggcagctttgctccaaaaggaacaccggtatggatttattctttaacttataatgcgacttacatggttccttcattcattatttgtgcaattgtcctatgtttattatttatgacagcaccccgtttgcttaaaagtgacaaagcgtaaaagtaacaatcccccagcgaattccgctgagggattgttcgttatctgttaagaagtgtttttaaagctgaaagatccggccagccaagacctacttctttcagccttactccggcaatttcaaagttgtcctccgctactctttcaggtgaataggcctgataaaatataattgagggattctgctcaataacccaaacaaacatacttgaaaatccatgttgaagcaaaaactccgctccttttgctaagagcgccctgcctgcaccttgccgctggcgctcttccagaagataaatagcgtataactcgccgtcatagccttcttgttcagagcgaataggtccaaatgaagcaaagccgaatactgaatccatttcgtcctgagcaacaaatactccttttaacgagcgacttttccatttgtcttcaaattccttatagttcaggctgtttaaataatcaatcgggataatttcgtggtatgttgtcctccagctgtctacatgcacttttgcaataccctttatatcctctaacttcgcttcacgtacagttaccatacggttctgtcctttccttactctgatttttggaccgttttggcttctttgatttcatttgttaattcattgatgctttgttttacgtttccttttcctgaaaagttctcaagcatttcttttacatcgattcccgaggatgcttttaaactttcttgcagacttgacattaagttcgtcgcatagctggttactttgtttgctccgcttgattcaccgcttcctcctgtatcgacaacggtgattttatcaatatttgaaagaggtgccgctgcttgtttcgcgtattccggaagcattttgacaatcatatcgaaaatcgccgcctgcccgtactgttcaaaggcggccgcaattttctcttttgcttccgcttctgcaagacctttcaggcggataacctctgcttctgtctctcctttcgctttttccgcttctgcttttgctagcccgtcaattcttactttttccgcctcagcctttgccattgcttcaatactgtacttcttggcatcggcttccgcgagctgtttggctttctcagctgctgcggactgctcaacagaataacggtctgcatcggcttttttctttacctctgagtcgtattgacgttcacggcgaagaatttctttttcttctagttctatttgtttttggcgttcgataattttaacctgcatttcctgctctgtgacttgctggcgcgctcgggcagtctctaaatcatatgcttggtcggcattcgcttttgccgtatcttgttctctgcggaattcagccattttgagctgattgattttttcagcttcagcgatttccgtcgcccgttcaagttctgatttttttgcgtctttatcggcttctgcccgcttaattcgggtttctttatcagcctctgctgttgcgatatcagcatcgcgttttacttgggcaattctcggtttccctaatgattcaagataaccgtttttatcacgaacatctttaatggtaaacgagacgattacaagtcccattttcgcgagatcctgtgaagcgacacgctgcacctcttgagagaatttttctctgtttttatagatttcttctactgtcattgagccgagaatggaacgaaggtggccttctaaaacctcccgcgcttcctgctcacggtcgtcttttgatttccctaaaaattgttcggccgctgtagcgatttctcctatagaaccgccgattttaataatcgcagttccatcggccattactggcactccttgttctgtatagacttcaggtgtcgaaacatcgagtttgcttgataataggcttagcggctctgcctgctggaagacgggaaggacaaaggttcctccgccgcggacgattttaatacggttgccgccttcatcgacatgaacatttttattacccagatagctccctgttacaattaacgcttcatcaggccctgctgtacgatacttcgtaataaacacagctattagtgcaattaataaaaagaatacaactccgatgatcattataatcggcattgtcatatcaaattcctccttttatgttaaatgggttcatgcggagtaaccgaaagaactccgtttttgacatctacgactagcactcttgtgccataaccgatctgttgattttcaaagctgatcgctgacttcgagatggtgccgcctatcccttcaatgaccacttcaccaaacccgtcaacaggaacagctgtaatcactttaccgagtcttcctctgagatcatcttctctatatgccaatgattcttctgcagatgataatggtaccagtacaaagatgtgaagcaataccaccagcatgatcgaaaggatgcaagataaaagcgcaatcagcaagcttgacagaggcaatacgagttcacctatatatccgtccgctgaaaaacatgtgaaaaatgagagcactaatgtcggattaagaaacggaatgccttctggcagccctgcaaatacatctccgaaaaacagaaataacagcgtaaggctgcccgcaataataagcgtataaagataaattgtttgtataggtactccaaataactccaatttcctcatcctttcttcatcaatgcattgatgaacggctgccgttaccattaatacgagacaccccgggaaaagtttcaaaattttaagataagtaacccatttgaagtgctttataaatgataattgcttatatatatggtaatgtcattttaggaggagatatgatgagtatctttaatgaagccagattagaaacgtggaacgaattgaaaggactttctgacgaaaagctgaatcaaaagccttctgctgaagaatggagcatacgggaagttcttgaccatttgaaaaaaatcgatatgaccgcacaaaaaatgttgaaggaacgtgtacaggacgctccgattaaagaaattgaagaaaaaccgcttgaggtagcacaggacagaaataataaacggaaagccccgagtcatcttgagcctgcgcatgattttatttcaggcagccaaatgaaacgtgagcttgatgtggtaagagagcagctgactgctgcgattgcctctctgaaagaagaagattttgaaagagtgcttccgcatcctgtgtttcaagagctgactgtcagacagtggatcgattttatcggccatcatgaaaaacggcacctcagccaaatgaaagaaattaaagaaaagatagaaagggcctgatttaatcagaccctttctgcttttcgtttgacttttcgctgataggaatgaacttctatttcatcacctgtgtaaacagcaccaggtctctccacaatacagacaacccctctaatgcccagtgcgtggcggacgaaagccggcgccagcttcggttggtccggataataagactgaatgacttctcccggctggatacacggatcattttcgccctcacacagcagagccgctccgctcggaaaaataatccggcttccttcttttaatgaagtaagatctggcataccgctgactgccacattcgccccgagccattccggcaaaattctcggcactcccatttttaaagcgatttcgttgcattcctctattgaaacaattgaaatttgtctgcggttgaaaatttcagtccctcttgaaaacattggttctctggctcccgcttttttggtcaggccaaaatgcaagtcgccggggatgccgccataatcaaaatcaagcttgtccatttgctttgttacgaagctttctgtatctgcgatatataagccttccgcttttgcagtcatacgcttccacatcagctggcaccttccttcttatctaaaatttccgcctatgcttcattatcccaaaaaatcccgctctgtaaaggagcgggattttgattataccgttttaggcgtaaggttaaagcagcgcttgtagatccagttgtatgctttttcatttaaatctctagggtttccgaaggtttgcggatctttcattgcttctttagacaagcgttcgatcatatcaggtgatactccctgctcttctaaagtcagcacttctaaatcttcgaccagatcatacatccaattgacagatgctttcgcagcttcttctgttgtcatcttgcttgtatcaataccgaacgctttcgcaatacgcgcaaacttctcaggatagcccttccagttgtattccatgacagggcccatcatcgccgctacacattggccgtgagcgactgggataataccgccaagcgtttggctcatcgcatgagccgcgcccgctgattcacttccgtaagaaaggccggcaagcatcgctgcctgcgccattccgtaccttgcttccagatcctctccgtcagcaaatgccctcttaatgtaatgagcggcatactcaatcgccattagggcaaccgcatccgtgattggctgtgcaaatttcattgtatagcactcaatggcatgggcgagcgcatcaattcccgtcatagctgttacatgcggaggcattgaaacatgaagctcaggatcaatgatggtcaagtgcgctgcaatcagcggaccgcccgtgttgaatttgaattctctttcttcatctgtgataaccgcccattgggttacttctgatcctgttccagctgtagtgggaattgtcgtcagcggaggaatgcggttttccagcggttttttcccatctgccgcttcataatcaagcacgcttccttcgtgagtcgcttctactccgattgcttttgctgtatccatggagcttccgcctccgactgccaccaaaccattacagttctcttttttgtaaagctcagatccttcattcaccagacggacaggcgggtttggctcaactttattaaagagcaccacttcaatgcctgcttctttaagtgattcgattacaggatcagcaacaccggctttataaatccctgggtctgtgacaaggagcgcttttgaaacgcccagtgcagctacttcctcacccgtatgcttgatggctccgattccatgcttaatcacagtcggaatttcaaatgtgtggaatttctgcatgctttctaccttcatatttaatgtcatcatcaatctccccctcttatgaattgaaccagttaaccgctgccggttttgtattacggtatacatgtttgacttctgtgtattcttcaaggcctatttttccaagctcgcgtccgaacccggattgcttatatccgccccatggcgcttgtgcaaagtacggatgaaaatcgttgatccaaacggttcccattctcaagcgggctgctacccgttcgcacttttcaatgtcttttgaccataccgctccagccaagccatagatggtatcattcgcaagctcgattacctcttcttcagagctgaaggtttcgactgtcaatacaggaccgaaaacctcttcctgaacgattctcatgtcagaattacagtttgagaaaatagtaggttcatagaaaaagccgttttgaagctcaggatcttccgggcgtttgcctcctgtctccagcttcgcgccttcctctattccgatctcaacatatttttctacctttgccctgtgctccgccgaaataagcggaccgctttctgtctcagcatgaaaaccgtttccgagttttatgcgttttgcccgtttgaccagctccgccaaaaattgatcatgaatggcatcctcaacaagcaagcgggaacctgcagagcatacttggccggcgtggaaaaatacagcgtttaaggcctgatcaaccgcaacttctaaatccgcgtccttgaaaacaatatttgggtttttcccgccaagttcaagggcgatttttttgacgtttccgcttgccgcccgcatgatttttttgcctgtttcaattccgcccgtaaacgaaatcaaatcgacgtctttgtttacggcaagctcgtcgcccactgtggctcccggtccaaggacaagatttgcgacaccttttggtacaccggcttcttccatcagcttaaagactttgattgtcgtcagcggcgtaatctcactcggcttcatgacgattgtgtttcctgcagccagtgcaggggcgattttccagctcgcttgaaggagcggataattccatggagtgatctggccgcaaaccccgattggctctctaataattttgctttctgaatcaggaatcggagatgaaatgatctctcctccatctttgtctgccaagccggcgtaatattgaaaaacattggcgatatcgtccatatcggccttgctttcttcgagtgtttttcctgtatcaagagattcaagctcagccagctcctcaagatcgcgtctgattaattccgcaattttcagaacaatttttccgcgttcaagcccggatagcgatgaccattctcctttgtcaaatgctctgcgtgcggctgcgattgctttgatggcgtcctctcgccctccctcgcttacagttgcaatttcttcttgattaaatggattgataatactgcggatctgttctttttcggcactgatccattctccgtcaatgaataatgtttgactcatataagcctccttgacgtaaataaagtttgttaaataaaaatttaatgtttttaacaaccttaatctaacatatggtttttaaactgtcaaagtcccattttgatttttctttttgacttttcctcatgtttcgttaagataaagaacataaagaaataacttaacgaatttaattttctaaaggaaaagagggtcagtatggatgaaaatccagaatttgcagctatagaacaggctcgggatcttgttattgactccattgctgaaacgatggatctttacggaattacccgcagtgtcgggattttatatgggacgatgtatatgagggatgagatgacgcttgacgaaatgcgtgaggagttgcaaatgagcaaaccaagcatgagcacaggcgtcaaaaagcttcaagacttaaatgtagtgaaaaaaacatttcaccggggcatccgtaagcatacatttgtggctgagaaggatttctttaaatttttcacaaatttctttccacctaaatgggagcgggaggttcaagtgaatgtagcagcgatcgaggaagctcaagctgatttacaaaaggttttatgcaaggaagatctcgatgaggatatcaaaaatgaagcactgcagttatatgatcagctggaaagctctaaagcttactatgactggctgaaacggcttgctgaatcggtgcagaccggagaaatttttaaatttataccgatcgaaacaaagtaaagcagaaaacgcctgggaaagcaggcgtttttttgatgtaactactacaaatttgaaaaatacgggaaaaacaccccatttacttccaaaatatttgatggtaattttatgtaggtaaaatttgtatttggcctttcagaggaggtgaaaagcgggcaggcctgtttaatttatcattttttagggggaattttgttatgaaacgcaaattattatcttctttggcaattagtgcattaagtctcgggttactcgtttctgcacctacagcttctttcgcggctgaatctacatcaactaaagctcatactgaatctactatgagaacacagtctacagcttcattgttcgcaacaatcactggcgccagcaaaacggaatggtctttctcagatatcgaattgacttaccgtccaaacacgcttctcagccttggcgttatggagtttacattgccaagcggatttactgcaaacacgaaagacacattgaacggaaatgccttgcgtacaacacagatcctcaataacgggaaaacagtaagagttcctttggcacttgatttgttaggagctggcgaatttaaattaaaactgaataacaaaacacttcctgccgcaggtacatatactttccgtgcagagaataaatcattaagcatcggaaataaattttacgcagaagccagcattgacgtggctaagcgcagcactcctccgactcagccttgcggttgcaactaatgtaaaagaccggttaacgccggtcttttttgcgttttaccctcccctttttctctaattcccgttatcttttttctggtttaaaatttaaattgacaaacactagaaacaggagtaaattcttgagtgttcaatttcatacagtctcttttaccgcttaatcaaacacgaacgggggaaccaacgattggctgttttattaacagccttggggtgaatcttactaagtaagagggggtactctgaatccctaatccgacagctaacctcgtaggcgtatacagagaggaggtctattatttggccattctttgcaatggtcttttttgcttcagaaacgttaattcactaagggagatatgaacattgggaagaattaaaaataagcaatttgccgtgatcggtctgggccggtttggcggcagcatttgtaaagaacttcatagaatggggcatgaggtccttgcggttgatatcaacgaagaaaaggtcaatgcatatgcttcttacgccactcatgcggtaattgccaacgccaccgaagaaaacgaattgctttcattaggaatacgcaattttgaatatgtgattgttgccatcggagcaaatattcaagcgagtacgctgaccaccctattattaaaggagcttgatattccaaatatttgggtgaaggctcaaaactattatcatcacaaggtgcttgaaaaaatcggcgctgaccggattattcatcctgaaaaagatatgggagttaaaatcgcacaaagcctttcagacgaaaatgttttgaattacattgatctatctgatgaatacagtattgtcgagctgctggctacgcgcaagcttgattcaaaatcgattattgacctgaatgtaagagcaaagtacggctgcacgatcctggccatcaaacatcatggagatatctgtctttcccccgcgcctgaagacatcattcacgagcaagattgcctggtgatcatgggccacaaaaaggatattaaacgttttgaaaacgaagggatgtagacaaaggtgacacttcaaaaggataaagtgatcaaatgggttcggtttacaccgcctcaagtgcttgccattggttttttccttaccattatcatcggggctgtcctattaatgcttccgatttccactacgaagccattgtcatggatagatgctctttttactgcggcttccgctacaactgttacagggcttgctgttgtcgataccggtactcaatttacggtattcgggcaaacagttattatggggctgattcagattggcgggcttggatttatgacgtttgcggtcttgatcgtcatgatattaggaaaaaaaatcggattaaaagaacgaatgctcgtccaggaagccttaaaccagccgacaatcggcggtgtcattggccttgtcaaagtcctgtttctgttttcgatcagtattgaattgatagcagcactcattttatccatccggcttgtacctcagtacggctggtcatccggcttgtttgcaagtttgtttcacgcaatatctgcttttaacaatgccgggttttcgttgtggcctgataatttgatgagctacgttggcgatcctacagtaaacctcgtgattactttcttatttattacaggagggatcggatttacggttctgtttgatgtgatgaaaaatcggcgttttaaagctttttctttacatacaaagctcatgcttacaggaacgctgatgttgaatgcgattgctatgcttacggtctttattttagaatacagcaaccccggcacgctcggccacctgcatatagtcgataaactgtgggcgtcctattttcaggcagtgacgccgagaaccgcaggcttcaattctctagattttggaagcatgagagaaggaacaattgtatttactttattattgatgtttatcggagcaggaagcgcatcaacggcgagcggcattaagctgactacgttcatcgtgattttaacatctgttattgcttacttgagaggtaaaaaagaaacggttattttccgccgttccatcaaatatccgattatcattaaagctttagctgtgagcgtcaccagtttgttcatcgtgtttttagggattttcgccctgacgatcacagaacaagcgccatttcttcaaattgtgtttgaaaccttttccgcattcggaactgtcggccttacgatggggcttactcctgaactgacaacagctggcaagtgtatcattattgtcatcatgtttatcggaagaattggtcctttaacgttcgtgttttcattcgcaaaaacagagcaatcaaatatccgttaccctgatggcgaagtgtttacagggtgatatcaaaaaaatccggcgtgcagtcgccggatttttttatgattcgatatgagattgattttgtcttttttcctgttccgcgatgatttcattatcctccgcgttatcacgggttactttttgtgtaagaatcgcaccaactgctacaagtatcataacagcgatgtaataacctttttcattgagttccaggttatcagcattatagagtccgatactaaacaaaaatactcccgcaaaaaaagtaaaataagctaatactgtaaaggcaaccgtgtttctgcgtctatatttctgcacctttgttccctcccgaaagcatagttaaaaagtgataacttccgtggaatattatacctcaaattccccgtaatggaacaaagaattaaaaataccagtaaaaagggcttaggttgcctcctttatttcaacagctgaatcatcaatccagccgataagtttatcattgatttggaattggtaccatacagactggcctttctgttttttagacacaacctttatgtctttgccgacgtaagattgggcagaggtaagccttatggaccgatcatcagtagagggcttggaccatacgtcttgaacggcactgtctttaatagaggcgtttaaatccacagatttgagggatggatttacctcatcgtactcatctaaatcgtatttttccacaatagcgctgattttgtcagcgtagtcagggtctgtagcatatcctgatgtttgcagggcggttgccgcttccttataattccctgcctcaagcaccggtttatacttctttttattccacgatgtgccacgaacgaacaattgggcgtgatcatccatagattcaaaaaacgtgctgtattttcgaaacttcgcgcgaatggtttttcttttccctttttcaacttcgtccgtttccatcgtgacatgatggcctttataattcccttttacgccaaaaaggttgttggccttagcagccagttcactgttcccccagtccgattcgagaatggcctgagcaattgtgatgctggggagaacatggtatttttcatacaaaatttgggcatgtccggacagactgtctataaatacttgctgttcatcgatttcttcagtttctttggatatttcaatcggttttgataaagttgtcgctaaaacaaacagagctagcggaatcgatacaaggaaaaatagtgaaatcaagagtttacgttttttaagttttttacgggccatgaaaaccttccttcgaattaaaagattacgaatgtaaaagaatctaccttttagaattttacttgcacttctaatatttttcaattctttagggataaagttgggaaaagattgcaaaataaaaaccttttcgctcaatgaaaaggtttttaccatgtttctatttttgtaaatttctgagtgcattacgatattccgtatcatttattactttatatgatttgacagttgccttcgacaaaccttctgctgaaacggccggtttttccggagctgttttcgctttatcatgtggtttatgtgccagcttgtgccccattccagtggcattcatacaaaatgacaggcagacgagcagcacgctaaggataaaagaaatgaagaagagatcatgataagcagtcatcatagaatcctgttccgaaccgctttgtctggcagcatcttttttcgtgaaaaagccgatgagaatgggaactcccatatagacaaacaatcttaaaaactgaacagctgtcattctcttgaccaaatcaggcagcgggcctcccatggcagctcccatcagccctgcggcgactgtcaggcctgttcccgctgcaagcatgataaacagtgccgcgaacatataaagagatgatcgatcctgtatatgcagccattgaaaattcacaaaaacgagaatgagtccgccgataataccgagcatccctggtccgactttatcatataacagagcgcttaaaatggccgcgatcgccactccgattaaaagagtcaagtttaaaaaaatgagatgctcctgagaaatatcatacatttgacggagcaagccttgaaaagcagacaggctgacagctaccgttatcgtccctgcagctatgatcaataagccaagcaccggttttggcagcagcatcagtttaatagatatgaaggggtttttcactttatattccacaatcaatagaccaatgagcaaacataacgtcaccccgaaaccaatccatacataacccgatgacagcccccatttttgcagaaaaatgaatgaaaccgctgaggctgcggcaaggaagacagataaaagaattcccgcacgatcaagcggctgttcttgatccgccgctccgtgatgctcatcatgaagaaagaaatagctcaccgcgacaccgatcagggacaaggtgccaaagatgataaacagccatctccaatgcccgcagcttgttgcaatggttcccaggattgtaccgatgataacagaaccatagaatcccccgatcagcacaagcagtgcatagttcctgcgttcaatcgggaatgacagtacaagcattggaatcataatcatcagcatgacgcctgttgccgccccctgtaaaaagcgccctgccgccatccatgcaatatcgcctgaacatgcgatgagcagtgagcctagtataaagacaggtaatgaagccagatagacgggacgcgcaccgaattttttcctcagcagcggtcctgccggaactaacaaggcaaaggccatattgccgatcaatatcgggtttactaatgtgaagacacttgttccaaccgctttctgaacaaggccttgaactgacgacaatgccgtgttagacatcaatcccggcccgaccgctaagacggcgagcaaagaaatcacccaatagtgttttgtcttcatgttgtcattccttcctatatgaatacatgcgaaacacatcattttttgaaaacaaaagaagctaatagattttgcataccattagctttcattctaatattctccctttcaggggaaatgatattattttattataattatgtgaatgaatgagcatataatcaaatattatttcaaatcgattgtgttttgtcaatggagtaaatttcaagcacaacatagaaagcttgaaagcttttccccgatattgtgtctagaactgcacttatgaatccctgctcgttccctcaagcgaattaaagcaggccgttttaatcctttcaatccactattcccactaataaactcgaataagttggtgataagacaacattttgcccccacatttttttgtgttcactgggcgtttgccgcctctaaattgtatatgggtaaataccatgaattaacctatgaaataccaatgtaaggaaattctaaatattccgggaggcaaaaacgaatggaactgtatgagtgtatccaagacatttttagcggcttgaaaaatccatcggttaaagatttagcaacgtctttaaaaaaaattccaaacgcagcaaaattaagtcaaccgtatattaaggaaccagaccagtacgcttacggccgaaatgccatctatcgaaataatgaattggaaattatcgtgattaacattccgccaaacaaggagacaacagtccacgatcatggtcaatccattggttgtgcaatggtgttagaaggaaagcttcttaattctatttatcgctcagccggcgaacacgcagaactctccaattcatactttgtccacgaaggagaatgccttatttcaaccaaaggtttaattcacaaaatgtctaatcccacatccgaacgaatggtgtctcttcatgtctactcccctcctttggaagacatgacggtctttgaggaacaaaaggaggtattggaaaattcatgattgacagataaactgctcactttgacttcgctcaactggaggattcagagaatgaatcttttcctcaaaacaaaaaaacccttatagaataagggtttacaggtatggagccaagggggctcgaacccctgacctctacgctgccagcgtagcgctctcccagctgagctatggccccgtatgtaatgtcatgtttattatagatgattttattttgaaaaacaagctgtttcctcttgaattgacagaaaaaataaggctcgtaaaagagccttattttcgacttacatcatgatcaaaagtaaaatcacaccgagaataattcgatagattgcaaatgggacaagtttgattttgttaatcagccttaagaagaaacggacgacaaacagtgcgacaacaaaggcacagataaagccgacgatgaaaaatggcatcagatccgagcttaagctgtcccaatgcttcacgaggcttagaaagctggctcccatcatgatcggcatcgccataataaacgtaaagtcggctgcagctcggtggtttaatccgagaataacaccgccggaaatggttgaacccgaacgcgagaaacccggccaaagggcaagacattggaataagccgacggctatcgcctgtttataggaaatgcggtcgagtgtgtctgtcgctgttttccgtttattgacccagtcagcaaaaagcatgaggattgccccggcaattaaaccgatggccacagttttaacggaaaataaatattcatcaatgtaatcttcaaacaaaaagccgagaacagctgcaggcacgagtccgacggcaatttgggcaatgcttaatttatgtccctgctcctggtcgcttgtaatattttttttcaagcccagtaagtttaaaattcggtctttaaacacgatagctactgctaaaatggagcctagctgaataaccaccttgaatgagttagcagcttcttctgacatcagattacttgatttaagccagatgtcgtctactataatcatatgtcctgtcgaagaaaccggcgcgtactctgttaatccttctacgattcctaaaatggcggctacaaacaattcccatagagtcatgattttgattctccccattagacatttatttttttacataacgggagcttcccataaatggaaagcccgtcttatataactataaacgaaaatcacactttatgccccggcgtattttcatttttttcttcatcgtataaatgtgaccgcattttaaaccagtcaaataaatgtgtcgtaatgactttggcaaccgcatagccgggaatcgcaagaatgattccaacaacgccgaacagcttgccggctgttaacagcagaaaaataatcgtaatcggatggatgtgaaggttttttcccataatttgcggagagatcagcttcccttcaatcagctgaacaatcgtccaaacgatcaccagcttaagcagcatgagcggcgatgtcactatggcaatgataatcgcaggcgtaatggcaatcgttggccctaaatatggaacgatgcttgtgcaagccgcaatgactgcaagcaatgaagcataatccagcccgataatcaaataaccgataaacagcaaaaacccgatacagaagctgacaatgatctggcctctgatataagagcttaaccgatgattcatttcgcttaagactgtgtatgtctgttctttcaattgcgtcggaacaaacttcagtatgtagaccggcaatttttttccgtcctttaacaaatagaaaaggataaacggaaccgtaacgattgaaatgataatctcagtcagggcgccgataaaattcccaacgccggtaaaggtactgttcacaattgtcgctgcctgatctgaaacctttgttgcgagatcagatatattgatgttcgtcgtttgctgggcctgattgacgaagttgctgccgatcagctgtttcgtctgattttcaacgatatccacatatcttgggatgttgtcgattaaactcataatttgttcttttaagaagggaatgatcgacacgattgtgatcgtgatcagcccgataaccaatagatatagcagcaatatagaatagattcttcttattcttcttctctcaaggaaatcgacgaccgggtttaacagataaaaaacaatgcctgtcaaaataatcggaagtgatatcgttttgagcaaaacaataatcggggtgaaaataaatgatgtttttgtaaatactagaatatttaaaccaatcagcagcagcacaagcaaaaataaaacaaacttattatccaagaagaatcgcttgaatctgccgctccatgtttgcaacgtctccactatcgttcctccgtcatacatagtttaattaaattgtacactatcgtccctataatgaaaaataaaaaccgttaattgctggaaaagctttcacggttttaacattctatttatatctatcatgtgattttgttctttttaagctataatttagctatatcatgcaaaaggagcgatacgagtgatacgttttgcaataataggaaccaactggattacagaccgctttcttgagtcagcagcggatatcgaagattttcagctgactgctgtttattcaagatcggctgaacgcgctggcgagtttgctgctaaacacaacgctgcgcatgccttctcagaccttcaggaaatggcggcgagcgattgctttgatgccgtatacatagcgagcccgaacgctcttcacaaggaacaagccgttctctttatgaaccatggcaagcatgtgctttgtgagaagccgtttgcttcgaatacaaaagaaacagaagagatgatctcagcggctaaggcaaacggcgttgttctcatggaagcaatgaagaccactttcctgccgaatttcaaagagctgaaaaaacacctgcataaaatcggcactgtccgcagatttaccgcaagctactgccagtattcctcacggtatgacgcgttcagaagcggaactgttttgaatgcgtttcagcctgagctttccaatgggtcattaatggatattggcgtctattgtatttatccggctgttgtgttgtttggcgcgccgaaggatgtaaaagcaaacggatatgctttatcctccggagtggacggagaaggaactgtcattctgtcttacgacgggttcgaagctgttctgatgcattccaaaatctctacttcctatgccccggctgaaatccagggtgaagacgggacgattgtaatcgatacgattcaccggcctgaacgtgttgaaatccgctaccgggacggccgccttgaaaacatcgcgatccctgatcctaaaccagcgatgttctatgaagcagaagaatttgtcacgctcataaaagagaataagctggaatctgaagaaaatacatttgaacggtctttgaccactgcaaagattatggaagaagcaagaaagcaaatggggattgtataccctgctgatcaagcttaaaaaaatccgcccgcgtgcaaatgccgcggcggattttttattaggcaatcggagaagatgccttcctttttaaaagcacctgttgctcatattctttgatgtcatgaagccatgcctcttttaccggaacgcccatttgctcacagtaggaatcccagatggctccgaaaggatatgttttgaattcctccatcagggccagcctttctgtatagcggccctcttcctgcaattgttttaaatatccgttcgggagaagcagggcatacaataaagctttgatcatatttctcgttccgatggtccaggcggctacacggttaatgctggcatcgaaaaaatccagaccgatggcgaccttctcaagagcatgatttcgtacaatttcaagagcgatttctctcaattcatcatccaaaaccactacatggtcgctatcccaacgaacaggccgcgatacgtgcaaggcaagcttgtctgtgtaaagcagcatggacgagatcttgtttgataccgtctcagtcggatggaaatggcctgtatcaagtaaacaaagcttatgattcgtcaaagcataagctaaataaaattcatgagatccgacaacatatgattcggagccaagcccgaacagcttgctctcgattgcatcaagattgtgttgttcactgatctcctctgcgaagatccgatccagtgattcttttagtcttttacgcggtgtcagcctatcactcgggatatccttatagccgtcgggaatccaaatattcgtcaagcaaggtgttcctaattctttcccgaagtattccccgatacggcggcaagcgatgcaatgcctgatccaaaattctctgatatccggatcagggtgtgaaagggtgagtccgtcagccgctttctcatgcgaaaacaaggttggattaaaatctaaaccgagaccaaggttttttgcccatttcacccagttttcaaaatgctgcggcttcaattcgtcacgttctaccgcttccctgtttgtttctgcgtatatcgcatgcaggtttacgcggtgctttccaggaatgagagaaagagccttctccaaatctcttcttaattcttcaggagtttgcgcttttccgggataattgccagtcacgtcaattccgcctgaaagctcgcccttatttacttcaaagccttcaatgtcgtcaccctgccagcaatggatcgaaatgggcacttgctctaattgccgaagcgcctcttcaacatcaattccccatttttcatatgcctgttttgcactgtcataattggcttttatggtcatacggctctctccctttatcagttttttaatccaaataaaaaacttcctttagatctatcgaaacaggactgaaatccgaatttgttttcattaatggcgccatcgatttccaccatcttcggcaaacttccgtgtccgccatctttctccatttctcttcatcctctatttctaaatatgcaaaaagcctgcctgtttcctcgtctagaaaaatggaataatggtgtgctccatgagctttgagtgcttctgccatctcaggccaaatgtcatcatgccgctgtttgtattcttcgtacttgtcttgatggacaaacatgatactggcttttcttttcaaaccttttcacctcttcatcatttagatagcgctttcaaaacagtttgctgaaatgactgaatgatcgtgcttctgtcaatgtctttaggtgtaaacactttgatcggaaaggaatttctgacgacttgccgggcttcttttatgtctttgacttctttggcagcaatcatttgcatcaaaagatttccggtggcagttgcctctatcggccctgcatataccgcttttccactcatgtctgccgttaattgatttaagaaatcattccgggctccgccgccgatgatatgaaattgctcgatcggtttttctgtgattgtttcgagctctttgatggctatcgcatagatgatggctaaattgctgtagatgcagcaggcaagttcgcctgcagtgcgaggagtcttttggcgggtttgtctgcaataatgttgtatttcctttatcatgttttctggattcaggaaacgtttatcatttaagtttataaattgctggaatggttctgtttttttggcttcttctgcaagctgctggaaagagtaatctgcttgtaactgttgtctgacttcttgtatcacccacatgccgataatgtttttgagaaagcgaatggtgttgtttgcgccgcgttcatttgtatagttgttttctaaagcaagatcagttattatcggtgttttgttttcaaccccgattaacgaccatgttccgctgctgatatacgcccagccatcatttattcctggcgctgcaatgacggccgaggccgtatcatgtgttgcgactgtcatcaccttgcacgccgggagatcataatccgggaaccactcatttcttagcttcccgagttcacaccccggttcagtcagcggggcaaattgctgttcctgaacggacacggcttcaagcaattcaggatcaagatttcccgttgaggcttttaaaagctgtgttgtggacgcatttgtgatttccgttacagcttttccggttaaacaatagcctaaataatcaggaatcatcataattttgtctgtctttatcagcagctcacggtcttcctcatacaattgatagatcgtgttgaaaggctgaaattgtattcctgttttttgataaattgcggcttttgagagggtatgttccagtttgtctattgtgtgatctgttcttctatcacggtaggagattgcttcccgcaaccgatcgcctttttcgtccagtaagacataatcaactgcccatgtatcaatgcctacggtgcagtgttcatacccaagcgtctttactttttgcagtccttgcaggatttgttttagcaaatgatcaatatcccaaaagcaatgcccgtctctttgactgaaaccgttagcgaacctgtgaatctcttgtatgtcaagcttcccttcattcagttcacctaccatgattctcccgcttgatgcgcctatatcaatggcagtataaatcatcctttcaccctctcttcgaaagaggaacagctgtcaccttcacctttttgtcctcaagagcttttaccgatgccggatcaagtccagaatccgtaataaggcggctgacatcttgcagcgaggcaatatgtgaaaactcgcggttcccccatttgcttgaatcggccatcaaaatggtctggtccgacctttcgatcatccgttttttgagcagcgcctgccactcatttgaatcactcatcccgttgtgtacgtcaaatcccttacatgacagaaaggttttattgacatgataggtctcaagtgaacgctctgctaacggaccggcaaatgataatgatttttccagcaaaatgccgcctgttgaaatgactgatatgttttctttattgctgagttcaatagctgctttcattgagtttgtaatcacggtgagctcaatgtcagggagtatttttgccatgtaccaagcggttgtgcttgcatcgagaatgattcggtctccgctttttacatatttggccgcttcgtgagcgatggcttttttttcgatgacattcgtgatttcccgttcagaaaaatgaatttctgattccttctgctgaatactgaccgctcctccgtggctccggctcagtttatgttctttttcaagcttttcaagatcacgccgaatggtttcctctgtgactgaaaatatgtcacttaattcggaaacgcggatgcttgaacgcatatttactatttccactattttttgctgccgttctgctactagcatcggtaacgcccttcctcatatcgtagtccgtcttatattttttatcatagcatatttctaacgcgtaaaagcagcagggacgccgccgtctaccgtgatcatgcagcccgttgttttttcggctttggaagaagcgaagaatgcaatggcttcggcaatatcctccgggtaaatattgacgagcaatgctgtccgtttccggtaatgttcctccagctgatccggttcaatcccgtacgccgcggctcgttcctcccgccagcttgaaccccagattgccgatccttgaagaaccgcatcaggcaaaacagagttgaccctaatgccgaattctccaccttctgcagcaatgcatcttgctaaatgggtttcaagcgccttaaccgagctgtaggcagaggcgtttttgcccgcataaaccgaatttttcgatccgacaaataccatgcttccgcctctattttggtgtttcatctgtttaaacgcttcacgggctacaaggaaatagcctgttcctaaaacattcatattaagattccattcttttagacttgtttcgtcaaatgggcttgatgtggccagcccggcattattgacgacgatatcaatgccgccgtaagcaagcgccgctcgttcaaaagctgattgtacgtcttcctcctttgtcacatccattttgacagccattgcccgtccttctccgtatgcatcgtttatttccccggcaattttctgtgcaccttctatattcagatcagctacgatcacgtgccctccctcagctgcaaatcggcggcatgctgcactgccgattccgccggctcctccagttatcaacgctacttttcgggaaaattctgcttccggcggggccagcgtgagtttatatagttcgagcggccaatattcgacatggtaggattcattttcatgtaaagaaacaaattgccccagagcggttgctcctttcatcacggcgatggccctccgatataaagccccgcttactttagacatggcataactttttcctgtattcaccattccgattcccggaatcaatatcacccgtggggaggattcaaagatttgatccccatcctgctgatttcgtgtaaagtaagcctgatactctgatgtaaaggtctcgactcctgacttgatcagatctgcaagcttgtgcacatcttgagtttccggattccaatcaatgtacagcggaacccgttttgtgtgaacaaggtgatccgggcatgccgcaccgatttgcgaaagtgctggcgcttggacactgtttacaaattccaagacatcgtcatgatcatcataggaaaggatcattttcttttcttcacttactgctcctctgatcacaggcatgatgcctgccaagatttgttttcttttatcctccggcagcggctgataccttttgcctccgaatacctcatgctgattgatacgatcgttaacatactgctcggcttcttgaatgatggatatcgttttttgataacatgtttcagacgtctctccccaagtgactaagccgtgtttctccattaatataagctcggcgtggggattgtttgctacgccttcagcgatcattttagacaaagtaaatccaggacggacgtatggcacccatacaaaccgatttccgtaaatgtcttcagcgatttgttttccattatccgcacagcatatgctgataatcgcatctggatgggtatggtcaacatgtttgtatggcagaaaagcgtgtaatagcgtttcaattgaagggcggggatgtttgctgtctatcatacaatgagacaggtagtctaccatttcttcatctggcatttggtcccttttaatcagcgggcggatatcatctaatttcaaaccggtaaagttatgcgctttcattgttgccaaatccgaaccgcttccttttacccacatgacttctatttcacggcctctaaaatccttttccgttgttttcatagatgtattccccccgccccagttgcagacagtgcggtctgacccgatcagattggacctgtacaccaattcctctacacctttaggcagccgtgcagctcgctctgaatcccatatatgtttcgccatatttgatattcctccatccccttttatttgtatccgttttcattatatatgatttctgtttgtttttgaattgtttttgtttatttttgcttttaacaaaaaagaaagcagcagatatgccgctttcttgtttcattatgattctattttaaatttcttcgtaatgtcctgaagttcttccgccatgtttgccaacgtttccgctgaagagctgatttcttccatggacgcaagctgttcttccgccgaagctgcgatatcctgaatgcctgctgagctttctttcgccactgcagaaatatcttcaacagcacttgacacttcctgtgatccggctgacagttgttcaaccgtcgcgttcaagttttgcaattcgccggaaatttgggttgtcatctcatagatttgtttaaagctttccgctgtttgatccgtaatctgcaagccttctttcacttcatgattcacggattggaacattgaaagtgaggtgctgatttccctgacaatctcttgaattaatccttcaatttccttggcggagtctgctgattgtacagcaagttttctaacctcttccgcaactactgagaaacctcttccgtattctcccgctcttgccgcctcaatcgcagcatttaatgcaagcaggttggtttgatcagcaatgccattaatcacattcaagatgcttgtgatatcttgcgattttgtttcaaggcccttcacaaccgcttccgctttttgaacggattggtcaattgttttcatctggccgactgtatgctccaccagcttttctccgctgcccgctgcctcagaggactgaatcgatgatttcgtaatggttgaagaggcctgagccacttttgaaatcccctcgttcatttgagaaagatgatttgagcttgtttccagtttctcgctttgtgcctcgttgccatctgagaattgttcgatggcaagtgtaatatgttcagttgccttgctcgtttgggctgcgcttgccgtcagctcctcagaagatgaagcaacgttttctacagacgtttgaataacgccgattacagaacgcaatgatgcagacatttcattaaagctttcgccaagctggccaaactcgtttttcgagtgaatgtcaatgacttctgtgagatctccactgctgatttttgcagacgttgagacaagttttcttaacggcttggtgatggcacggataatatagagaatgagtatgccgccgattacaattgacacgcatagaatgataaccgcagtgttcagcaccggacttgaagcatcttgcaattcactgacaaaatatgtgcctgcgattttccagccagtcagtttatttgtcgtaaaggccattttcttttctttgccttcgaatatatattcaaatgagccttcttttttggaatatacttggtttgtccaatcgccggatccggttgtccccggcttaattgtcggatgggcgatatattttttgttgccagtcgtaataaatgcaaagccttctttaccgattttgattctttgtgatgcagtaagcacttcatccaggtttaaatcaagcgctataacccctgaaccgtcttttaattgttttgaaattgtgacaacgatatctcctgtcgcttcatcagtatacggttctgagaaaacagcttgtcctttttccgcaaccgcctgtttgtaccagtcacgtcctgtcggatcgaaacctttcggaacaccgctatccggatatttataaagcttcttatcttctgaagcagcatagattgcgcctacatcgtcgttaagtgtcgtgtactgcttaaatttctctttcagtaatgttttgtttttgcctaacaatatgtctttatcgactgtctcactataataatctattgcttttactttatcttctaatttattttgcagcgtactgtttagttcttcaacatttcccttcgcactgtttatgagctctctgtctaacgcgttccaagctgattgataactgaaatatgctaaaaccccaaccggcaaaataagcactgccagaaacgcagcgattagcggtttgctgatcgatggctgtttgatccaatgtatgaattttcccattcttgttgactcctcctttaagataaatctaatatcgtcaaactaggataaaaggtttaataaaaaaactaaaaaaaacacccaagcgtaacaagcttgggtgttaaggcttattattcgattttgaatcgtttggtcatatcgcgaagctcttccgccatagacgaaagggtctctgcagacgagctgatttcttccatggaagcaagctgctcttcggctgacgccgcgatatcttgtatatgcgctgaactttcttttgaaatcgatgcaatgtgctcagacgctcccgaaacttcttcggagctggcagaaagctgctgaaccgtcgcactcatattttgcagttcgccggcgatttggttcgtcatttcagaaatgcgtttgaagctcatttctgttttatctgtgatgtcaagtcctgtctgcacctcttgattgacagattggaacatgccgagtgatgtattgatttccttcacaatttcgatgattaatccttcaatctcttttgctgaatctgctgactgtactgccagttttcttacttcttccgctacaacggagaagccgcggccgtactcgcctgcgcgcgctgcttcaattgctgcgtttaaggcaagcaggttcgtctggtctgcgatgccattgatcacacgcaaaatgtttgtaatatctttcgatttcgtttccaatccgcgtacgacttgctccgcttctttaacggacttgtcaatgacattcatttggccgacggtttgatgaacaagcttgccgccttcacttgcaatttctgtcgattgaacagatgaatcagtgatcacttcagaagcttgagccatattcgtcaacccgtcattcatttgataaatgtgctctgctgccgtttcaatgttttcgttttgtttttcattgccgttagaaaattgttcaatcgccaatgtaatgtgctctgttgccttgctcgtttgcgcagctgatgcagtgagctcctcagaggaagcggcaacattatctacggaatcctggatggcgtgtatgagagaacgaagtgacgacgccatattgttaaagcttttgccaagctcgcccaattcatcttttgaacggatatcaatggtttccgtcaaatctccctcgctgatccgcttagaggaaccgacaagctgtttcagcggtgttgtaatcgaccgaatgatcaaagtcatgacgataatccctatgataatagctgcggccaagacaattaaagcaaggtgtaggacaggctgggctgcctcatggatttcatccaaatacatggtgccgccgatcttccatcccgtcaacttgtttgtgtcaaaggccatttttttcttatcgccatccatggtgtattgaaaatcgcctttatcagcactcaacatcttatcgagccagtcgccttttaattcagttcctgatttttcattaggatgagcgacaacttttttgtccttcgtcatgataaatgcgtagccttgtgtgccgatgttgacttttttggttgttttcagcagattttcaatggtcatgttgattgcgataacgcctgaaccatcttttgtctgctgggcgattgtcacaaccatcgtatttgtcgacgcggttttataagggtctgtgatcacgactttccctttatttgcaaccgcttttttgtaccagtcgcgttcaaccggattgtagccgcttggcatcggaagatccggatagcgggtaaagtgcccttttgtgtcacttgtataaatggattctacatccttgttaatgctgatatattgtgagaatttctctgcaatgcttgcattgctttttgcattgtatttctcttttgtcagccattcgctgaaataatcagcactgttttctttttcgccgatgctggtgttaatgatttcgtttaattgctgtacattttccaatgcgctccccatcatctgtctgtcgagtgagctgctagccgattgataggcaaagatcgccaatataacaaccggtatgatgaggatcgacagaaaggaaacaagaagcttccgtgtaattgatctttgttttatgagttggagtatttttttcatcattcatttctccttttttatgctacccttcatatcggctggaaatgggtaaatatatacagcaaaaaagaagaaatttaacaaaagtaactaatttcccataaataaatagtattttagacctattatttatctactttaaattgttttgtcagatcacggagttcttcagacattctttcaagcgtcagtgcagatgaactaatctcctccatggatgccagctgttcctcagctgaagcggcgatatcttggatgccatccgagctttccttagaaatggcagtgatatcatttgaagctgcggaaatttcttgagctcccgatgacagctcctcaaccgtcgcattcatgttttgcagctcggaagcaatttgattggtcatttgcgatatatgtttgaagctctgtttagtttcatccgtcatgacaagccctgtttcaacttctttgtttacggactgaagcacgttcagtgatgtgtgaatttcttttactatttcactgatcagcgattcaatttcttttgctgagtcagccgactgtaccgcgagctttctcacttcctcagcgacgactgaaaagccccggccatattcacccgctctggccgcttcaatggcggcatttaaagccaaaagattggtttgatccgcaatgccgttgatgacacgcaaaatattcgtgatatcctttgatttgatctccagccctttcaccacttgttccgctgattttacagaatggtcaattgtgttcatttggccggctgttttctggacgagtgtctcccctttacttgacacttctgttgaatctgcggatgtttctgtaatcactgctgcagcccgcgccagctctgccaatccgtcattcatttcattaatttgttcggttgtcgtttctattttctcgctttggctttcactgccgtttgaaaattgctcgatagccatcgtaatgtgctcagtggctctgcttgtctggtctgccgatgcagtcagctcttcagacgatgaggcaacgtgttctactgagtctttgatcccgtgaatgagcgagcgaagcgagtgtgccatatgattgaagctctcgctcagaacgccgagttcatcttttgaattgatttcaatcgtttcggttagatcgccttcactaattttttcagcggatgcgacaatgcgtctcaatggctttgtgatggatcgaatcacaaaataaatcgccgtcattccagctgcgatggcaatcgccagaacgattgaagccatgatcagaaccctgcttgcagcatcgtgaatctcgtttgcatacatcgtgccgctgattttccagcctgttgtttcgcttgttgcaaatgccatttttttctttttgcctttgtacgtatattcaaagtccccgcttttatccttgtagagcttatcaacccagtccccttttagctctgttcccgctttttctccggagtaggcgatgactttcttgttttggctcaaaataaaagcatagccttcttttccgatattgattcctttcgcggtagtgactaagtcatcaattttcatatcaatggcgacaacacctgacccatccaccgtttgacgggcgatggtgacgaccatttttcctgatgaaatcgattcataaggctcagtgacaattgttttgcctttattggccattgcttctttgtaccaatctcgttccaaagcattaaagtcacttggcatgtcagcgtacggataacgggtgaattccccgtctttgccgcttgaaaataccgcagcgacattatcattcatttggataaattgtttaaattcctgtttcagctctgttttctttttatcctgaaatttttcttctgtagcccaatcgctgaaatatgcgaggcttttttcagtcgtgctgattttatcatcaatgatgtgatctaatatctgaacattttcctttgcgctttgcgtcatctgtacatcaagtgaggcaactgctgattgataagcgctaaccgaaagggcggttatcggaacaattaagatcagcaggaaagaaataataagtctccttgcaattgatgatctgcgaatagtggtgagtgtttttttcatttccttttgaaccttctttcaataatttacaaattatatcggcggatcttcctttaaattacattgaaaatggaggaaaaaatgaaaaatagttctaaattcacctgttaaactaggactttattattgtttaccatataaaaaacagcgctttgatagcgctgtttttcggcttttactcgattttaaattgtttcgtcagatcacgaagctcttctgccatctgcgcaagagtggtcgctgaggaactgatttcttccatggaagcaagctgttcttcagctgatgcggcaatgtcctggatgcttgccgagctttctttcgacacgtctgcaatgccgctgactgctgctgaaacatgctgtgaacgatctgacagctgctcgacggtggaattcatcgtctgcagcttgcccgcgatttcgtttgtcatgctgaaaatgctctggaagctttcttttgtattgtctgtgacaacaagtccggactgtacttcctgattgacctctttaaacatgtgaagagaggtttcgatttctgcgacgatttcttggatcagcttttcgatttcttttgctgaatcggctgattggacagccagcttgcgcacttcctccgctacgacagagaagccgcgtccagactctccggcacgcgccgcttcaatggctgcatttagtgcaagcagatttgtttggtcagcgattccgttgatgactctcaaaatgcttgtgatgtcttttgattttccttctaagcctttgacaacagcttcagcctgctgaacagattgattaatcgagttcatttgtccgactgtctgctgcacaaacttctcacccgttccggcgatttccgttgattggatagatgcctttgtaatatctgacgatgtttgtgagacttgctggagtccttcattcattaagttcagctgatgagagctggattcaaccttttcgctttgctcctcgtttccgtttgagaactgctcaatcgccatcgtaatatgctcggtggctttactcgtctgcccggcagatgcggtaagctgttcggaagatgcggccacattgttcaccgagtcctgaatagcactgatcagcgagcggagagattgtcccatttcattgaagctttccccaagctccccaagctcatcctttgaatggatttcgatcgtttcggtcagatcccccctgctgatcgttttcgatgattgaacaagatgttttaacggttttgtaatcgaacgaacgataaacagaattaaaattccgcccgccacaatggaagcaatcagcacaatcattcctgtagtcagcacagactttgaggcatccttaatttcatccatatacattgtgccggctattttccaaccagtcagttcgtttgtagtataggtcatctttttatcttcgttattaagagtatactggagttcaccgctgtcattcgcatacattttggctacccagtcgcctgaaagcttttctccagccttatggttcttgtgggcgacataggttttgttttttgttgcaatgaaagcataaccttcttttccgaccttgatttgtttcatttgttctaacaatttatcaatggtaatatccatggcgacaacgccagatccgtccttcagctcctgtgcaatggtaatgaccatgcttccgtcactcgcagccacgtaaggatctgtcacgacaatttcaccgccggccttcatcgcatcctggtaccaaggccgttgtctcgggtcgtatccttccggcaatttttcttttggcgcttgtacataagtgccgttatctgcgcccccataaattctggctactccttgattaatagatacatattgtgaaaatttagctttgatctcttcttgattcgatttccctttgaatgcggaccttttaagagattcactgaaaaaggtgactgctttcgctttttctcccagatcatttgtaacagttgtattaaatgtatcgacactgtttttcgcatttcccataatttcctgatccagctttccgctggcgcttcggtaagagctaaattctaatataagaatagggataatgagaatcgcaataaatgagacgattaatttctttgaaatagacggtttcttaagccaattgataaaagtcttcatgtccacttgctccttcaggtttgatacagtatatatcggctgcttaaaaaagttttaaaataaaaaatggaagaagttctttttggctgtcttctgtcgttttaactttcattgcccaagctctttgcatatcttataaaaaacaaggggggctaaacatgattattgtatcaggacaattgctccgtccccaggatattgaaaattggcagattgatcaaaatctgaatccgctgttaaaagagatgattgagacgcctgttcagtttgattatcattcaattgctgaactgatgtttgagcttaaactgcggatgaatattgtagcagcggcaaagacgctgcacaaaagcggggcgaagtttgccacttttttaaaaacatacgggaatacaacgtattggagggtttcaccggagggcgccttggagctgaaatacagaatgccgccttcaaaagcgattcgtgacattgctgagaacggcccgttttatgcgtttgaatgcgcaaccgcaatcgttatcatttattacttggccttaatcgatactatcggagaagataaattcaatgccagctttgacagaattattttatatgactggcattatgagaaattgccgctctatacggaaacaggacaccactttttccttggagattgtttgtattttaagaatcctgaatttgatccacaaaaggcgcaatggagaggcgaaaatgtgattttactgggggaagataaatattttgcccatggtcttggaatcttaaacggaaagcaaattattgataagctgaattcttttaggaaaaaaggagccttacagtcagcctaccttctgtctcaggcgaccagactggatgttccgtctcttttccgcatcgtccgctaaaaagccccatcgcctattttccggacgatggggtttcaaatgcctttcgttttcgatagaagggggctgtgccgaaatattggttcgcagcccactccattttttcaaggtcatttcttgtcacgattggatcctggctgctccatttgataaagcggacaaaatagtagcctttgataggaaccattgtaacttttgagtgaggccagccttcaaatacaaactcaattttccctctttttttataagagtattgaagaatgttcatatttgtcacctcagtttatcaagttacgttcggcaaagctcggtacgtttacatccattgattgactatccctcatgcatgctttcctgaaaacaaagggtgaggcgcgtgtctctttccctcgctttttatttcgcatatggacgaatgccaagcgcgccttcattcgataaagcggcagccggggcgggtgtgacaagccctccggctatcggcgtttgttcagcgatcatgcttttgtcaaaaaaacagcctattatcccatcattttgatatagcatgtccgggtgcgagggccgtcaaattcgcagaaataaatgccctgccaagttccaagaatgagccggccgttttccacaatgacatgctgtgaagctccgactgtactcgacttcatgtgtgcagctgtattgccctccatatggcggtccagctcatgttcccacggatatacctcatcaaaccttctgagcatatcttttttgacgtccggatcggcattttcattaattgtaatgcccgcagtcgtatgcggacagtaaatcagcgctgcgccgctcgttatacctgtttcttgaagaaacgcttccacctcccgggtgatatcaatcatttcatctcgtttggttgttttgatttgcagtgttttcagcatttgtttctcctttcgtttgtccgctctcatcgcttaattcgttctgtgttcttttttttcctgttaaaccgctctcataaacccgataaaacaaaaaaactccagtctaaggctggagtttagcaccatagatatattcttgcttcatacggctttaagagtactgatgtcatatgcttgtgcggctctgtttcaatatttgacaagacgagtgcatctgatgacaatggcaatccagagtgcctgaacaacgccggtgttcctgtcagattggccgcaatcagtgcagtatggctctcgtttttccgaagatatgcaaagatttgctgatcttccggtaaaatgagctcgtatgtcccgttaataaaaacatcatatgtttggcgcagcttgatcaagcttttgtaaaaatggtaaacggatgttttatcgtttttttgcgcctcggcattcagccatttgtaattctcattgattccgatccacggtttggcctcagaaaatccggcgtatggacctgcattccattgcatcggcgttcttgaattgtctcttccctttttccagacaatcttcatcacatcctcgtgtgatgtgcctttcgctgtttttgtttcatacaggcgtttcattgcgacatcatcatagtcctcaatagagggaaaagccacgttcgtcatcccgagttcctgtccctgataaataaacggtgtgcctttcatgagaaaataaacagcggaaagcgcttttgcactttctttcaggtacactccgtcgtctccccacacagaaactgaacggggctggtcgtgattctccataaacaaagcattccagccgatcccttccagactgtcctgccagtcagttaaaattcgtttaaatgcaacgatatcaatactttcattgatctctacatcccacaggccgagatgctcaaattgaaaaatcatgctgaatatgccgtttttttctccagcccaatcagctgcttcttttgcagcgacgccgtttgcttcaccaactgtcataatcggatagcgggaaaatgtgttttccttcagctctgttaacaaatccataatgccgtcagcattcatatgataaggaaaggaagggacatagtccaatccctttggattcggcatgtcgggaagcccttcttttttcttaatatgcgtaatggcatccacccgaaatccgtcaattcctttatcaagccaccaattgatcatgtcataaacggcattcctcacctgttcattttcccaattcaaatcaggctgttttttatcaaaaaggtgcagataatactggcttgtcttttgatcatactcccaagccggcccgccgaaaatgctttcccaattgttgggcgcttttccgtttttgccgtctttccaaatataccagtcgcgcttttccgagtgtatggatgaacgggattctatgaaccatggatgttcgtcgcttgtgtggttcacaacgagatccataatcagcttcatccccagatcatgaatgtcaccaagcagttcatcaaaatcttccatggtgccaaactcgcttaatatgttttgataatcccggatatcatagccattatcagcattcggtgagtcatacagcgggcaaatccatatgacgtcagcgcccagctcttttatgtaagaaagcttggatctgattccttgaatatccccgattccgtcgccatttgaatctttaaaactgcgggggtaaatttggtaaacaacggtttccttccaccaagcctttttcatacagccactcctttccagtgtaccggtcttatatatcctatgtagaaaaaaggcttcacagcattgctttttaagaaatgacttgatgacacaaaaaacagccgtttgttccccggctgttttttatcaaaaatcagttttttttatttctacaaaacggatgtggtgatcttcggcgtcgaggattttaaattcacagccctccgcgtgtatcacatcccctgctttcagctccattttttgcgttagaagccagcctgcaatcgtatcaatttcttcattttcaatcgcaatgtcgagaaggtcattcacttcgtctattagcgcttttccatccatcacataatggtgctcgccctttttcaggatgtgcggtgtttcatcctgatcatactcatcgcggatttccccgacgatttcctcgataatatcctctacagtgacaagccccgccgttcccccgtattcatcgacaagaatcgccatgtgaatccgctccttctgcatgcggattaaaagctgctgaacaggaatgctttcaatgaccctgataacgggcctcatgatttgctccagctttatcggctggccgagaaaataagctttaaacatatctttgctgttgatgatccctaaaatatgatccttgtcatctttgatgacagggtagcgtgtataccgttcattaatgatgtgatgaattgcctcttcaagcgactgctccagagagataaccgcaatttctgtccgcggaatcataatctctctcgctacccggttgtcaaattcaaaaatcttatttacataacggaattcagactgattaatttctcccttttcatagctttctgaaaggatcagtcttagttcctcctcgctgatgacaacctgatgctcctttactgaatgaaagccaaacaatttcacaagaaaacttgcagagccgtttaatgctttaataaacgggtacgtgattttataaaaccagatcagcggctttgcaatccataagcttacagcttcagctttttgaatagaaaccgttttcggagcaagctcccccatcaccacatgcaaaaaagtgacgatgataaatgcaactacaaatgtgacaatgtggttaaacggttccggcatgcctgtcattgtaaataagggatgaagaaaacgttcaaatgtaggttcaccaagccatccaaggccgagggcagtaatcgtaatcccgagctggcaggctgataaatactcgtcaagattggagatgattttatgtgcggctagcgctcggctgtcaccgctttcgatgagctgattgatttttgaacctctgattttgacgatcgcaaattccgctgcaacgaaaacagccgtaatgccaatcaaaacaaaaatggcgatcaattgtaaaataagcaaaaaaagcccttaccataaatggtaaggggccacctccttaacgttaattctcatcacgaccgtttaagaaaatcatcacaaaacgaagtagttcaaacagggaaaccagggcggcggccacatacgttaaggcagcagcgctcagcactttatttaccccattttcttcattgtttcggatgaatccttctgacacaataatctgcttggcgcgtgaacttgcattgaattcgacaggcaatgtaatcagctggaaaaagactgccgctgaaaacagtatgatgccaagcccgatcaaattcaggctgccgagaagcatgcctcctaagaaaagcaaaggagctacaccggatgcaaaattcacgactgggaagattttatgtctcagcacaagcgcaccatatgactcctgatgctgcaaggcatgtccgacttcatgggaagctacggatatggcggaaattgagcggccgtaatagaccggctcagataaacgcaccacccgtcttgtcgggtcgtaatggtctgttaaagtgcctcttaccggttcgaccggcacgtcgtaaagaccgtttatatctaaaatccgtcttgccgtttctgcccctgtacgtccgcttgaggcttccacttttgaatatttttcaaagttgctctttactttaaattgtgcccaaaacgacaatcccaatgcggctattgttaaaaatataaacagcattttttcatcatcctttttccatgatcatttctctattaagattattttaatgagttttctttcccgtgtacagaaatgcgctttttcttccggcttggagcacagaatccaatcagcaaaaagaacaggcctgctgaaaacaaataaaaggcgaaaccgccggccagttctttcagaaaataaaaccaggagaagctgccggaaaagtgattatatgaattcaaatcgaaaataaacaaaatcaccgcggatgccgccagctgtgtaccgatcaaaaccacgatcgttctttgaaagatcgtcatctttttcatcctttttgttttagtttatggagaaatccggttttatatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagataagtacggccaggaaaagctaaatgaaaaattaaatacaattattaaacagattttatccatctcagtatctgaagaaggagaaaaagaatgaaatcaaatcggatatttatttcatggctcaggtggccgttatttatccgaatcggggttattattttatgtctgattcttttgttcggccaaatcatttatatacttgagcctaagcagttcacttcggtattcgaaggcatttggtgggctgtcgttacggtttcgacagtcggttatggagactatgtgccgcacacgccgctgggacaggcagccggaatactgctgattttgagcggagcaagctttgtcacagcatatttcgctacgttatcagcggccgcattcagcagacagcatcgctacatcgaaggaaaagttgcttacaaaggccgggaccacatcattctgatcgggtggaatgaaaaaacaaaccggcttttgaaggaccttcagcttgccgccccttccaaaacggtcgtactaatcgatgaatccttaacagaaggcccgcttattgaaaacgttcatttcatacgcgggcacgctgccgatgatgggacactgaaacgggccaatattactgaagcggaatcagtgatgattactgccgatcagtataaaagtgaaactgatgctgatatgctgtcagtgctgactcttttatctgttaaagggcttaatccccttgcttactgcatcgtcgagattttgactgaccgttttgtcaccaatgcggagcgggcaggtgcaaaccaaatcatcggaacttcagaatttatcagccgggcgatgctgcagcattaccaagtcaagttacggccgtctaaacagcagaacggaatcaagctgacacttgatcagcatgtggagcttcttgctgttcctgacgaactaaagggagcggcttacaaaacctgtgttctctatttccttgatcacaacacaacaattataggcgtacaaaaagaggaggggccgatgatttcccctcctcttacatacaaggtgctcgaaacagatcaattccttgccatctagtgtaacagaacatcctccaattctttcacgagagaggcgccgatatccaaaaatgccggatcaatttccgcgtcccgcctttccggttcggaaaattgattaaacagtgattggaaaggccctccctcggcgtgatcgtcaacatccgcctgaaacacctgtctcagcataaacggcgttccgatccggacggccgcccctcgttcatcgagactgccctgtaccgcattgacgggaattcttaaaaataaatagccgtctctatcatcaattttataatcaaagtagccatgatcgtattcccagccgccgtttatcacataaccgagcggcttcatcacttgttccagttcttgaagcagaaaagactgcccatctatcgcggaaggtattggtatcatcagaatgccccttttttcacttatcctgtcccgccgaacaagacttcattcagaggcgcctacatggaaatcgttgtttctttcgcgcggccaacagaaaagaaagcgcattcaattaagaagtaaacagtcattgccgctgcaagccatacagctgaatcccaagacacataaacaaccgttgcatagagtcctaatttagtgaaaagagtatgggttcgttttaaatgcaaaatccgatgtaccgcatcggtaaaaagggcaagcggcaaaccaatgagaagaaaggcgtggatgaaaaaatgtgaaagcgtgccgccaaagcttgaagaaaactctgtatacacggcatcaaaggagataaggaaacttaaaatagctgcagaaaaaccggcaatgatgagatgtttaaccaattgtttcatgaacatcagcacctttctgattttataaaaagccgaccggcaaatgccagtcagctttctcacattaatcttccagacgtttttcaagctctgcttttttctcttcaaagccaggtttgccgagtaacgcaaacatattgactttatacgcttctacaccaggctggtcaaacggattgacgccaaggaggtaaccgctcatcgcgcaggctttttcgaagaaatatacaaggtatccaaaagtatatgcattcagctcaggaatgttaacgattaagttcggaacatttccgtctgtatgggcaagcattgtgccttggaatgctttcttgttaacgaaatcaacagttttaccggctaaatagttcaagccgtcaagatcgttatccgcttcctcaattgtcagttcatgtttaggtttctctacgttcaggaccgtttcgaataaatctctgcggccttcttgtacatactggcctaaagaatgaaggtctgttgaatagttcgctgaagaaggataaatgcccttctcatctttcccttcgctttctccgaacagctgcttccaccattccgcaaagtattgaagcgccggttcgtagttgatgagcatttcaattgttttgcccttattataaaggacattgcgaacaaccgcatattggtatgctgggttatcttccagttcagatgttgcaaaatctttgctcgcatccagggcgcctttcatcatgtcatcaatgttgacgccgctgacagcaatcggcaagaggcctacagctgttaaaactgaataacggccgccgacatcgtcaggaataacaaatgattcgaaaccttcttcgttagaaagcgtttttaatgcgccgcgctctttatcagttgttgcataaatccgcgctttcgcttcttctttaccgtatttctcttcaagaagcttgcggaaaatacggaaagcgattgcaggttcagttgttgtacctgatttagaaatcacattaatagagaagtcaacatcttcaagaagatccatgacgtctctcatataagatgaactgatgttgttcccgataaaaatgacttgcggattgccgcgttttgcttttggcaaagtgttataaaacgcgtgattcagcgcttcaatcgctgcccgcgctccaagataagaaccgccgatgccgacaacaagcaagacatcagagtcagatttgattttttccgcgctttttttgatgcgcgcgaattcttctttatcataatgttcagggaggtccacccagcctagaaaatcgctgcccgcgcctgttttttcatggatattatggtgtgctgtttttacaaagtcccgcaggtatgtaagttcatgttcgttgaagaaagtcaacgcttttgagtagtcaaagcgtacatgcgtcattgcttgtccctccataacggtataatgttttcatctttcactttatatgaacttatctgtgaaatcaagtcaagaagaaagggcggaatgactggattccgccctttgggtttatagagacgcgcgaaggatggcaagcacgtcatctttgttcagtttttggaagttgccgaagcccccgtgttccatttccttggctgcgatatcagcaatcagttcaagcttttcttctccaatattgtaatcagcaagacgagaaggtgcaccgaggcttgtccagaacgcagacagtttatcgattccttcaagcgcaatttctttatctgttttgccttcagtatcaatgtcaaacatgttgagcattaggtttttaaaacggcctacatttgtatcaagcgtgtatctcatccagtttgggaacagtatcgccaaaccgcccgcgtgcggaatatcatatacagctgaaacagcgtgttccattgtatgagaagcccagtcaccaaagtagcccatttggagcgtgccgtttaaagcaatagtaccagcgtacaaaatcgtttcacgaagtttgtagttttccagatcttcaagaagcttaggagctgtttcgatgaccgtctgcaaaacagcaaagcacattctatcctgaagcggcgtgttttcaacattatggaaatattgttcgaatacgtggctcatcatgtcaaccatgccgtatactgtttgattttctggaacggtgaacgtattttcagggtctaaaatagagaaacgcggatgagtgacattgctgccccatacaaatttctcgtttgtttcccagtttgtaatcacggaatctgggttcatttcagaccctgttgcagcaagagttaaaacagtgccaaacggcagcgcatcctccgctgttacttttttgctgaaaatatcccaagcgtcgccatcgtatttgacgccagctgcgattgcctttgtacagtcaatcacactgcctccgccgacagcaagcagaaaatcaatgtcatgctctctgcaaagtcctatgcctttttccactgttgcaagacgcgggttcggctctacacctgacagctcatgaacaacagcgccctcttcttttaaaatgcctgtgacttgatcataaaggccgttgcgtttaatgctgccgcccccgtaaacaagcagtacattcttgccgtattgtttgaattcttttcttaattgatcaagctgaccttttccaaaaatcagctttgtcggattataataagtgaaattttccatagtaaaacctccaaatgatgctggtaaaaaacagattttccattgtaacataagttgacaaaaagaaaaagggaagcagccaaacggctatttcccctttttttatagagatgctttcaaaattgaaagcacatcttctttgttgagtgatttaaattggccgaatgtaccgttagccattgccttgtcagcaattgtgtcaagctgctcatcattaatatcataatcagcaagacggttcggagcgccaaggcttgtccagaatgcggacagcttatcgataccttcaagggcaatttcttcatccgttttacctgcttcttcaacatcaaacacgcgaactgcaagctgtttcatgcgggcagggttttcagacaatgtgtgtctcatccagttcgggaacaaaattgccagtccgccggcatgcggaatatcataaacggctgatactgcatgttcaatattatgagtagcccaatcccctcttgcccccatagaaagcatgccgtttaatgcgattgttcctgtgtacaggatcgtctcacgcaattcgtaattttcgagatcattgatcagcttaggcgctgtttcaatgactgtacgcagaagtgattcacacatgcggtcctgatacggcgtgtttgatacatgatggaagtattgttcgaatacgtggctcatcatgtcaaccatcccgtagatcgtgtggtttttaggtactgtgaatgtattcaccggatcaagaatcgaaaatttagggaatacgagcgggctgccccagccgtatttttcttttgtttcccagtttgtaataacagatcctgagttcatttctgaaccagtcgcagcgagagtcaataccgttccgaatggcaaagcatcttttggctgatgctttttcgtaacgatatcccacgcatcaccatcatactttgctcctgcggcaatcgcttttgtacagtcgattacgcttccgcctccgacagccagcaagaaatcaatgttttgttctttacagatggcaacacctttattaacagtcgacacacgaggattcggttccacacctgctaattcatgcacggtcgctccggctttattcagctgttcaatcacttgatcatacaggccgctgcgtttaatgctgccgcctccgtacacaagcaatacgttttttccgtaaggtttgagttcctccggaagtctttccacttcgccgcgcccgaaaattaatttggtcggattccagtatgtaaagttttgcatgacatctcctccttagattttttattatgcagaatgtcctcaccacatgtaaagcaatcagctctcaccgatcagcataccagatggttttattttgcaagatgctgggaaagaagctgatataagcgagggcaggccagcctcatatggagaatgcatgtatagattctccaatatgtcacaatctataactgttttaataattcatggaggaggttgcaaaacatgagtaccattcaaagaatttgtcttgtattaaccatcattggcgccattaactggggactgatcggatttttccaatttgacttagtagcggctatcttcggcggccaagggtcagctctttcccgaatcatttacggacttgtcggaatcgccggcttaatcaacctcggtctgctatttaagccaaacgaggaaagatcacgtgaagaagcagcaaatcctgaaatgcgataggatatcaatcacgctgaaataggattttgtattaaatcaaaagcaccgaacattcctgtccggtgctttttttcatgcttattttttgataaggtctttgcggttggacatttcgatccactcttcaagcttatcttttaatgtgttgaaaccttgtggtgtagaagcttcttcgcttacttgagcagctttaggttttcttggtttgctttcttttttctcaggcgcagcttgtgtcgcacgaattgaaaggctgattttgcctttttcttcatcaacagcaagtacttttacttgtacttcgtcgccaactgaaaggtgctcgttgatatcttttacgaaaccgtgagtcacttcagaaatgtgtactaaaccttgagtttcttcatctaatgcaacaaacgcaccatacgcttgtaatcctgtaactttaccagtgtaaacactgcccacttcaaattttgctgccattcataacaactcctaagttaaattaaatatctgtttatacgcaatttaaaattatatcacacatgtcttatttccgcaaagaaaactttttcataaaaaaatcaggtttatgcacagcaaaaagggggtaaactgaaaataccaaaggctttctagtattcccccttttattggatgcgaacaaaaggttcgtatctttttttatattgttttgtgcaggaagcgtttcattctgactaacgcttcttgaagctgttcaatcgaggttgcgtatgaacaacggatatatccctcaccgctcggaccaaacacacttccaggaacaacggccactttttcttgcgtcagaagctcctcggcaaactgttctgaactcatccccgtgcttttaattgatggaaaagcatagaaagcgccgcccggatgatgacagctgagaccgatttcattgagcgattctacaaacagattccgtcttcttcgatagctttttttcattttttctacgtcttccatgccgttcttcaggccttcaagggcggcaaactgcgccattgcgggcgcacacatcatcgcatattgatgaattttaagcatggcatcccgaagcaaggatggtgccgcggcaaaaccgagcctccagcccgtcattgcaaatgcttttgaaaagcctgagatgactaccgtccgttccttcattcccggtaatgccgctatacttgtaaattcctcatcatatgtcagctccgcgtagatctcgtcggctaagacgatgacatcatgttttttggcaaactcagcaatctcattcagctcttccttcgaataaaccgaacctgtcggattcgatggtgagcagatgagaatggcctttgttttttcagtgactgccgcttcaaaatcagcagccgttgctttaaatcctttgtctgccgttgtatgaacgtgaaccgggataccgcctgccaaagaaacaagcgcatcatacgccacaaaacacggctcaggaatgatgacttcctcacctggattcacaatggcgcggatcgcaatatccaaagcctgacttgcccccactgtcacaatcagctcattatctggcgagtagctaagatcaaacctgttgctcaaataacggctgatttcctcccgcaatgagtataaacccgcattggccgtgtatgacgtatatccttgttcaagagagagaatgcttgcttcgcggacattccacgcggtaacaaaatcaggctcgccgacgcctaaagaaatgacgccttccatcgttgccgccaaatcaaagaatttgcggatgccggatggttttatttgttgtacatagtctgataaatacgaagtcatttacggtgacaccacgattcttttgtcgtcgtctcctgtttcaaacactttgccgtcatgcttgtattttttcaggataaaatgggttgtcgtagatacaactgaatcaagcgttgagagtttatccgaaacaaaacgcgctacgtcagacatcgaattgccgcgaatcacgacagacaaatcgtatacgcctgacatcaggtaaactgattcaacctcttggaatcggtaaatccgttccgccacttcatcaaaaccgacgccccgcttcggcgttactttgacgtcgatcatggccgtaacgccctcatgtccgtctacttttcgccaatcaatcatagcggaataatcgataataaccttttctttttccagtttgtcaataattgtttttacttcatttacagggatgcccgccatctttgcgattgtttctaaatcggcgcggctgttttcgtctaaaatttctaatatttctgtttctttttctgtcagtttcatttgattcacacctttgcaatgtcaagaaatctcatgacattatatcacgttttttgacgaatgctaagaaaaaacgaggagaaacttccgctagaatttacaatttcagggcataatacaaccatcaaaaaaagggagtgacacagaatggaggcggtttcaccaataaggcggtttacggtcgatggagtcaatgtatactacgaacattatcaaaatcccggcaggcaaacgctggtttgcgtacacggttttttatcatctgcattcagcttcagaaaagtaattcctctccttcgggacaagtacgacatcatcgcgcttgatttgcctcctttcggccaatctgaaaaatcaagaacgtttatctatacctatcaaaaccttgctaagcttgtcattgggattttggagcacttgcaagtgaaacaggctgtgcttgtcgggcattctatgggcgggcagatatcgctgtctgctgctctccaaaaacctgagcttttttcaaaggttgtgctgctttgcagttcagggtatttaaaacgttcacacccgacgatcattttcgggacccatatcccgtattttcatctttatatcaaacgctggctctcgaaagaaggcgtgatgaaaaatttattaaatgtggtgcatgacaaatcgctgattgatgaggagatgattgacggctatggcagaccgtttcaggacgagcagattttcaaagccatgacaaggtttatccgccacagagaaggagatttagaacccgagcaattgaagaaaatgaacaagcctgctctattgatttggggcgaggaggatcgaattgtcccaatggagatcggtaaacggctgcacgcagatttgcctaattccgtgctgtactcacttggccagaccggacatctggtgcctgaagaacggcctgaacttgtttctgaacacattgctgattttatcaattaaaaaaaccggtgctgaaccggtttttttaaggcgtgcaggagctgctgtttttaatgaataaaagctggccagccacttcccggcagctgtcgatcggcagcgtttgttcaaaagaagtttcaaatatttgctgaatgcttttcgccagcacgtcaggatcgtcttcatcatagactgcctgcacgacatcaacagcctccgtttcgtaaaactcttctccatatttaaacgggtcccatttggcaatgatcttaatcatttccctgaccgcttgactttcttccatattcatcaccgcttataataaaatttgcagttctatcttatcatagtgaagcttagaagaataaacatacatgagggggtaacagaatgaactttgataaacgagaagaacgccttggcacccaatcggtcaaatgggacaaaacaggcgaattatttggcgtgacagacgcactcccgatgtgggtggcggatatggattttcgcgcgccagaagcgataactgaagcgttaaaagagcgtcttgaccacggtatttttggttatacaactccagatcaaaaaacgagggatgctgtgtgcggatggatgcaaaacaggcacggctggaaggtgaatccggaaagcatcacattcagccccggcgttgtaacggctttgagcatggcggtacaagcttttacggagccgggcgatcaagtagttgttcagcctccagtttatacgcctttttaccatatggtggagaaaaacggccggcacattttacataatccgctgctagaaaaagacggcgcatatgcaatggattttgaagatttggagacgaagcttagtgacccaagtgttacattgtttattttatgcaatcctcataacccttctgggcgttcatggggccgggaagacttactgaagctaggcgaattgtgccttgagcatggcgtcacagttgtatcggatgaaatccattctgatttaatgctgtacggacacatacacacgccgttcgcttcgctctctgacgatttcgctgatatttctgtgacatgtgctgctccaagcaaaacatttaatatcgccggattgcaggcttcagcaatcattattccggatcgcctgaagcgcgccaagttttccgcaagccttcagcgcaatggtttaggcggactgaacgcgtttgccgtcactgcaatcgaagccgcgtattcaaaagggggaccgtggcttgatggattgatctcttacattgagagaaacatgaacgaagcggaagcctttttgagcaccgagctgccaaaggtcaaaatgatgaagccggatgcatcatacttgatttggctcgacttcagcgcttacggcttgtccgatgcagagcttcagcaaagaatgctaaaaaaaggaaaagttattttagagcccgggacgaaatacgggcctggcggagaaggatttatgcgcctgaacgcaggatgctctcttgcaaccctgcaggacggcctgcgccgcatcaaagccgcattatcgtaaatatagctgttaaacgcctttacgtcttcatttgtaaaggcgttcttaataaaggaattttatattttacttctaatatttagtgttataatagattcatattttatacgaaaggatttcacacgaatggaaattctaaaagactatcttctgcacatctgctttattttgtttcctattcttctttaccaagtgttttggcttggaaaacctgcgattcttgtgccaaaaataaacagcggtttggtcacgctcttcgcctgcggcgcctccgttttatgcattattttcccgattcatgaaatggactacatacaatacggccttcagatgattcccgttatcatttgtttattttacattagtaccgcttccggacttacagtcgccgcatctgtcctatgttttgaactgcttttttacgaaccttccgcaatgtttgttttcactttgctgccttttcttatcattatcccaatcttatttcagaaaaaatggccattcatgtccaaagcgaaaaaactgctgctgtctttattgatcagctgcgtggagattttcctatttttcgcctcaagctggattctttccgccttgaatattttaaattttcaaaaatcaggaattttcgtttacgaggcggcagtctcagggcttttccgctccagtgttcttctattaagcatctatattatcgaaagcatcgccgaaaatatcgccctgcgctcacagcttatccattctgaaaaaatgacgattgtgagtgaactggcagcgagcgtcgctcatgaggtcaggaatccgctgacagttgtccgcgggtttgtccagctgctttttaatgatgaaaccttacaaaacaagtcgagtgcagattacaaaaagcttgtactgtcagagcttgaccgggcgcaaggcattattacaaactatctcgatatggccaaacagcaattatacgaaaaagaggtttttgacctatctgcccttatcaaagagacaagctcccttatggtgtcgtacgccaattacaagtcagtaaccgtcgaggctgaaacagaaccggaccttttgatatacggagacgcaacaaagctgaagcaggctgtcatcaacctgatgaaaaacagtattgaagcggttcctcacggtaaggggatgatccacatatcagccaaaagaaacggccatacgatcatgatcaacatcacagacaatggggtcgggatgacagaccatcaaatgcaaaaactcggcgaaccttattattccttaaaaacgaacggaacgggactcggcctcaccgtaaccttttccattattgaacatcatcacgggaccatttcatttaacagcagcttccaaaaaggcactacggtgaccattaagcttcccgctgatcttcctcactagcaaatcgattggaactttaatagaataaatgcgaggtgatgacagatgagcacgtttgagacaggctctatcgttaaaggattttacaaaacaggtgtatacataggagaaatcacggcttgcaggccgcagcattatttagtgaaagtgaaagcggttcttacccatcccgctcaaggagaccttcatcatccaaaacaggcggatgtgccattttttcatgagagaaaagcgctcgcacatggtgaacagaccaatatcccccaccatatggtgaagccttatgacggtgaagtgccggattataccgaatctctgcgggaggcgacagcacagctgagagccaaattggatgaggatggttcggagtgggcaaaacgctcccttcataatctggacattttagaaaaagaatattttaacctgccataacccagtctgacaaaagattgggttttttacgtcgcgcgcttcaacagttcggttaaatcgattctctcgccgattgtgggcggttttggcttttcgagatactgcttatcctgctcaacaagcttaaaaagtttatatgctgtaagagcatcatcaagcgctttatgatgggtgccggttccggaatctccatactcttcggcagctttccataaacccgtcaatgtccggtctccaaaaaagtttttgtattcaagcgataaatctctcatttctcccttaaacgggaaagggatatggttaaacatacagttttgcttcagcactttcatatccatgtttccccacgtaataattgtgctgtttttctcaggatccagctcgtttagtttacggatgaaatcctcgaatctcattccttcgtctacctgtttttgggttatttttaaaaatgatttgcagcgtttcgtaagcttcgggaactttttcggtctaacatagctagaaaacgtctcaaccacttcatcatcaatcgactttacaattccggcttcaatgatttccgggaagaagttttgaggactgtactttccgtcaggcattgtaaattcgaaatcaataatgagtaagctgtttgtcgtcacctttttacacctgcctttcctccgatcagaaaatgctatctttatagtatatcaattccccttctcgacatttcttcattttctaaaaataatgaattttcccagccgcttcgtttcttttaaattgtgaatcgtttctttataattagtaaggaacccgaaataataagaaggtgatgttatttctatccgtaagaaaaactttgtcattgtgtggctggcgaacttttttgtctccgctagcacaacgatgatcgttccttttctctccttatacattgagacgctcagctctttttcaaacggctttgtgcaaaggtggagcggctatgtgttcggcattacatttctcatggcgttcttggtatccccgttttggggacggttcggagacaaacgcggatataagaaaatccttatggcaaccggaacgggcattgccctcagcattttcttcatgggctttgttacatcggtgtaccaattgttttttctgcgtatggcaatgggtcttgtaaccggattcatcccgacatctcttgcgatgatttcggcacagactccgaagagctcagccggcaaaacactcggcacgctgcaaatggggcaagtgtccggaagcttgttcggcccgcttttgggaggcatgcttgctgatcgtttcggctttacgtataccttttttatcacatcctttgtgattttctcgtctgttcttctcgtgttatttggtgtcaaagaaaagcctcttgcagagaaaacagccaaacgtacgtcttactcgaggaaagaagtgctatcctatatttttcaccagccggcgctgtgggtcatgatgctgttaaccatgctgattcaaacaggcaatttcagtatccagcccctgctcgctttatatgtaaatgagctgcatggacctgtcaatcttgcctttttctccggcatggcattttcagcaacggggctcggaagtttgctgctggctagaaaatggggtgatctgggcgaccgctacggccaccgccgcattttaatcggacttttgctcgccgcctctttcttttttattccgcaggcgctcgcgtcctcactcagcgtgctccttgttttcagatttttattcgggatggcgatgggcggtttgctgccatgcattacggcagcgatccgcgttcaggctcccggcagcattcaaggtgaagttctcggctacaatgtcagctttcgctttttaggaaacgtgctcgggcctctgctcggcggaatcatatcgagccattttaccatttcggccaccttttacgtcacggcgtttctctttttcgccggcgcctgcatgctttggatcatgcagaaacttcggaaagattcttatgccaaagcaagctgattccgagaaaaaactgaggaatcttctaaatttaaccttctcgtaatctcaaaagaatggtacgatatggctagaatttaggagaaaagagagtgaccatgttacgaaaaataatcggatggattttgctcctttgcataatcccattgtttgcatttacagttatcgcttccggaaaagaagtaaaacaaatgaagtccctggatcaggtgcttgataaaaatattaatctgaaagatatcagccttgttcagaacagctacatgtatgacagggacggctcccttgtctcggaaatcgtcagcgaccacgaaaaccgtgtgctcgttccatttaacaagattcccgaggaagtcaaacagattttcttaacatctgaggaccgccatttttacgagcataaaggctttgactttatgggaatggtgcgggctactgcttctaacgtaaaagacaagaaaattgaccagggtgccagcaccatcacacagcagctttcaagaaacttatatttgagccacgaacgctccttcagccgcaagctgacagagctcgcgtattcctatcagctggagaaaaaatatacgaaaaatgaaattcttgaagcttacttaaataccatttattttaacaatggtgtttatggcgtcggttcagcagctcaattctatttcagcaaaccgctgaaatctctcacagtgggagaaatggcttttatctgtgctatacctaataaccctacattatatgatcctctcaagcattttgactacacgaaaagccgtcaagaacgtttgcttaaagggctaaaagatgccggggtcattacggacaaagagctgaaaaaagccgtaaaacaaaaaatcaaactggatgttgaaaaaagagaagacaaatatcctgactacgtttcctacgtcaatgatgaattcactcagctggtgtctgaatcagaaggctttgataaacgccttcaaaaagcatcaggaaaacaaaaagaaaagatcgagaacgagctgtccgcaagagtcagcactctgatgaaagacggcgtgaaaatttatactgcacttgatccgtacatgcaaaatcaagttgtggcacaaatgaattccaagctcccgtatgcggacgtacagggcggagcggctgtgattaatcaccagacgcatcaaatcatcgctctatccggcgggaaaaactatcaaaaatatgactttaaccgcgcctaccaggcgtacaggcagccgggttcatccattaagccgcttcttgattacggcccttatattgaacagaccggcgcgacaacaagcagcaccattgatgccagcaagttttgcagcaaagactactgtccgcaaaactacaataaccgcacttacggcacagtgacgcttgatacggcgtttaaaaattcatataataccccggctattagaatgctcgaccgcgtcggcatccaaaaggcattcagttatattgagccgtatcattttgccaaacttgtcgacagtgactatcttcttccggcggcgcttggcggatttacaaacggcatgacgcctcttgagatgacaaaggcttatacgacattcggaaacagcggaagctatacgccgagccatgcgattacaaaggtgacagaccttaaaggaaaaacactttataaatggaatgataaagcgactcaaatattcagcgtccgcacgaacatgcagctgaaaaaactgatgtcttccgttgtgaaaagcggaacagggaaaaaagcatatttcaatgcgccttacatcggcggtaaaaccggaacatcaaatgattatcacgatatgtggtttgtcggcctgactgatacgtatacaatgggtgtctgggtcggaaaggatacaccgaccagcgttgaatatcttcacagcatcagccctcagctttccatctggaaaggaacgctgcaagcggcttattaaaggatcggaggggatatggagtgacttcagaacaaattccaaatcgcgttttgctgtttgacggtgtctgcaatttatgcaatggagccgtgcagtttatcattaaacgtgatccggacggattgatttctttcacatcgctgcagtcggaaacaggacagagcctgctgaaaaaaagcgggcttccgactgatcggtttgacagctttgtctttattgaagacggccaagtgtacacaaagtcaactgcagccattaaggttttcaggcatctgcgaggcccatggcggctcttcgtcctgtttttcgcagtgccgaagcctgtcagagatatggtctattcttttattgccaacaaccgctataagtggtttggcaaaaaaaatgaatgtatgctcccctccccttctattaaaaaaagatttttaccgtaaataaaaaatggctaggaagctagccaacacagattgttgacaaaatcctaaaacggcttcgttttaggattttgtcatcttttcagcgtgattgaaaacctttgaagtcgacgaagagcgagcattggatgtgaaacggcaggaacctgagaatctagccgccgttttattgcgtacagagcacgaagcgcaaatctgaccactaaacgctgaaatggctagcttacacaggtaagctagccattatgctattataaagcttgataaatatgaacagaataccgataacaaaggtaaaccaaaacagcagttccaatagaatgaatccaactaatgacatgagagaaagcgtcgaataaatccggtacacggtaaacacaaagtaagcgagcgtgacgaccgcaaaccagatcacaatccaaatgacattttgcaagagcacaaaggataaaatcccgccgcccaaataaatcatggaacccattctgagttttttcaggttgttcccttccggatcattagcaaaaaacagcaatgacagctcggtcacggtatttgcaattaatttcagagcggacagaaccataaaatataaaagtgcaaaggcagcaaataacgcaagcctgattcctttctctgaaaaataatcgagcattccatcatacattccaaatgaagacagcatcttcaacgcataaagtgaagttgagatggataaggacgaactaaaaagcaggatcgcaatcagcggaaaatatcctgtcaaataagtatttttcatataaaaaagtccctttctataatctacctcatttattatggaggacttaaaacacattgacaagataaattattccattttttctcctttttacgaattacggtcccaaatcttcacaaagcagcattttgagagtaaagtagtacgcaggaatcataaaacgtaaggaagttttatatgaaaaaaacattaaaactgcaaaccagactcaccatatttgtttgtatcgttgtattaatcgcattgctcattacgttttttacagtcggtgcccaaaccaccaaacgaattagagatcaggaaaaggccactgcgctgcagactgctgaaatggtagctgaggcgccgatgacagccgctgctttagaaagcggaaaaaaacaaaaggaactgcagagctacacaaagcgggttcagaaaattaccggcacggaatttgttgtcgtcatggatatgaacggtatccgcaaaacccatcctgacccgagcaaaatcggaaaaaaattcagaggcggtgatgagtccgaggtattaaaagggcatgtccatatcagcacagcctctggcacgctcgggaaatcgcagagagcgttcgtccctgtctacgcggagaatgggaaacaagtcggtgcagtcgcggtcggcatcaccgtaaatgaaattgatgaagtgatcagccatagcttacggccgctttactttattatttgcgtcagcatcttcgtcggtgtgatcggagccgttatcgtcgcccgtacagtgaaaaatatcatgtacggacttgaaccttatgaaattgcgactctgcttgaagaacggagcgcgatgctggaatcgacgaaggaaggaatactcgctgtcgatgaacatggcaaaattaaacttgccaacgcggaagcaaaacgcctattcgtcaaaatgggcatcaacacaaatcccattgatcaggatgtagatgacatcttgccgaaaagccgcttgaaaaaggtcattgagacaaaaaaacctcttcaagacagagacgtccgcattaacgggctggagcttgtgtttaatgaagttcctatccagctgaaaggacaaactgtcggagcgattgcaacattccgcgacaagaccgaggtaaaacatttagctgaacagctttccggtgttaaaatgtatgcaaacgcactgagagcgcagtctcatgaatttatgaacaaactgcatgttatattaggtctcgtccagctgaaagagtatgatgatcttggagattatattaaagatatagccatacagcaaaaatcagaaacaagtgaaattataaatgatgtcaaaagctccgtactggccggttttctgctcggaaagcaaagctttatacgtgagcagggcgcaaatcttgatattgaatgcaacggtgtcatcccgaacgcggcagacccttctgtcatccatgaacttattacaatcatcggaaatctcatcaacaatggcttagacgccgttgccgatatgccgaaaaaacaaatcaccatgtccatgcgcttccataacagcatacttgatattgaaattaccgatactggagcaggcatgtctgaagaagaccaagccaaagtatttgaacaaggctattcaacaaagggcaaaaaccggggattcggcctttatttcacacagcaaagcatcgaaaatttaaaaggccaaatgatcctcacaagcgaaaagaatgaaggaacgacattcagtattcgcatcccgtacgaaccgaaggaggaaaatcatgattaatgtactaatagttgaagatgaccccatggtgggtgaattaaataaacgatacttaagccaaatagatggctttcagctgaaaggcatcgcttcttcctttcaaagcgctctgcatattttaggcgagcaccatatcgacctcattttgcttgatatttatatgccgggaaaaaacgggctggaactgctgacggaattgagagcccaaaatgaagcggttgacgtgattgtcatctcagcggccagcgagcttgacgtaatcaagaaaacacttcggtacggagctgtcgattatttaatcaaaccgtttgaatttgaacgtttccaaacggctctgtctgattacagacgaaaacaaaaggtgtattcaacccatcgcaacatgagccaaaaagaactggacgccgagctttttcaaaagaaagaagcaacagaaaaagtgcagcttcctaaaggcctgacaaaaagcacgctgaagctgatctggtccagtatccagtcatttgaaaatgaatcttttacgacagaagacttggcaaagcacacagaaatctctcaagtatccatacgaaaatacttaaagtttcttgaagatatacaagttctgaatgtagaaatggcgtacggaacgatcggaagacctgtgtttcagtacaacgtaaacaacagtaaccttaacggaataaagcaatatctataagaaaacgcactgcttgctttgagcagtgcgtttttctgtcatatctcttgccaagatgcttgattctattgttgataagttatacaagaataacaaagggctttcacatttttaagcaaataattctaaaaatagatactttttaaaaaattatgcgaaattctatttatttcttattagttaaatgataaattatgattggttagttgatcccgaaaaactaagtcataagtcttacttcagaaaacgatgtcacggttttccgcccggaacgccttccgcatccttctcttccccgcctttcgaaggaaatactcacaccacgcttattcagggaagaatagaactgtctcagcgcattccatttgttattatcagaaaattttatcgattctaagaaattgttcaggacagcccatcacatgactggccggatcagctttgaaccaaatttttctggggggttatatcttgaataaacgaaaaatcggattggcgatgtcacttgtgatcgcagcaggcaccatattaggagcatgcggaaacagcgaaaaaagcagcggctcaggcgaaggcaaaaacaaattcagtgtggcgatggttactgacgtaggcggagtggatgacaaatccttcaaccaatcagcctgggaaggcatccaagcctttgggaaagagaatgggctgaaaaaaggcaaaaacggttacgactatcttcaatccaaatcagatgcagactatacaacgaacttaaataaattggcgcgtgagaattttgacttaatttacggcgtcggctacttaatggaggattcaatcagcgaaattgctgaccagcgcaaaaatacaaactttgcgattatagatgctgttgtcgataaagacaacgtcgcaagtattacgtttaaagagcaggaaggctcatttctcgtcggagtggccgcagccctatcaagcaaatcaggaaaaatcggctttgtaggcggcatggaatcagagttaatcaaaaaattcgaggtcggcttccgtgccggcgtacaagcagttaaccctaaagccgttgtagaagtgaaatacgcaggggggttcgataaagccgatgtcggcaaagcaaccgccgaaagcatgtataaatcaggcgtagatgttatttatcactctgcgggcgccactggcacaggcgtctttactgaagcgaaaaacctgaaaaaagaagatccaaaacgcgatgtctgggtcatcggtgtcgataaagaccaatacgcagaaggccaggtagaaggaacagatgataacgtcaccctcacttccatggtgaaaaaagtagatacagtcgttgaagatgtaacgaaaaaagcgagtgacggaaagttcccgggcggcgaaacacttacctacgggcttgatcaagacggagtcggcatttctccatctaaacaaaatctatcggatgatgtgatcaaagcggtcgataaatggaagaaaaaaatcatcgacggattggaaatcccggcaactgagaaagagctgaaaaccttcaaagctgaataagaatcgcagggataaggaggtcgagcccttatcccttgtttttcttttattttgaaataaaggagcggtcaatcaatggaatatgtcattgaaatgctcaatatccgcaaggcgtttccaggtatcgtcgccaatgacaatatcaatcttcaagtcaaaaaaggcgaaatacacgcgttgctcggtgaaaacggagcggggaaatcaacgttgatgaatgtccttttcgggctgtatcagccggagcggggtgaaattcgggtgcgcggcgagaaggtgcacatcaacagcccgaacaaagcgaatgaacttggaattggaatggtgcaccagcactttatgcttgttgacacctttacagttgctgaaaatattattctcgggaaggagccaaagaagtttggcagaattgaccggaagcgtgctggccaagaggtgcaggacatttccgatcgatacggcctgcagatccatcctgaagcaaaagcagctgacatatcagtcggtatgcagcagcgcgcagaaatattaaaaaccctctaccgcggtgccgacattctgatttttgatgaaccgacggctgttttgacgcctcatgaaattaaggaactgatgcaaattatgaagaacctggtcaaagaagggaagtccatcatcttaatcacccataagctgaaagagattatggagatttgtgaccgcgttacggttatccgtaaaggaaaaggcatcaaaacccttgatgtccgtgatacaaaccaagacgaactcgccagtctaatggtcggccgcgaggtatcgttcaaaactgaaaagagagctgctcagccgggagcggaagtgcttgcgattgacggcataactgtaaaggatacccgcggaatagagacagtcagagatttgtctctttctgtcaaagcgggagaaatagtcggcatagcaggcgtcgacggaaacgggcaatcagagctgatcgaagcggtgacaggactccgcaaaacagattcaggaacaatcaccttaaacggaaaacagatccaaaacctgacgccaagaaaaatcactgaatccgggatcgggcatattcctcaggatcgccataaacacggtctcgtccttgattttccaatcggagagaatatcctgctgcaaagctattacaaaaagccgtattcagcattgggcgttttacataaaggcgaaatgtacaaaaaagcacgcagcctgatcagcgagtacgacgtcagaacgccggatgaatatacacacgctcgggcattgtcaggcggaaaccagcaaaaagcgattatcgggcgggaagtagaccgaaatcctgatttattaattgccgcccagccgactcgcggccttgatgtcggagcgattgaatttgtccataaaaagctcattgagcagcgtgatgccgggaaagccgttcttctcctctcgtttgagcttgaagaaattatgaatctcagtgacagaatcgccgttatttttgaaggacgcattatcgccagcgttaatccgcaggaaaccactgaacaggagcttggtctcttgatggcaggaagcacgcaaaaggaagcggggaaagcaaatggttaaacgactctctcatttactcgtgccgctcatcgcaatcatccttggtcttgcggccggcgcgttgattatgcttgtgagcggctacagtgtggctagcggatattcggctttgtggaatgggatattcggagaaatctattatgtcggagaaacaatccggcaaattacgccttatattttatccggattggctgtcgcctttgcattccgaaccggactctttaatatcggcgtcgagggacagctgctcgtcggctggacagcagcggtttgggtcggtacggcgtttgacggaccggcatatattcacttgccgctcgcattgattacagcggcagctgcaggaggattatgggggtttattcccggcattttgaaagcgcgattttacgttcatgaagtcattgtcaccattatgatgaattatatcgcgctgcacatgaccaattacatcatttcaaacgtcttgacagatcatcaggacaagacggggaaaattcacgaatccgcctccctccgctctccttttcttgaacagatcaccgattactcacggctgcatttgggaatcatcgttgcccttctcgcagcagttatcatgtggtttatcatcaacaaaactacaaaaggatttgagctccgggcggtcgggtttaaccagcacgcttcccagtatgccggcatgagcgtgcggaagaatatcatgacctccatgcttatctccggcgcttttgcaggccttgccggagccatggagggcctagggacattcgaatacgcagcagtgaaaggcgcatttaccggcgtaggctttgacggtatcgctgtcgctcttctcgggggaaacacagccgtaggcgttgtactggcagcatgcctgcttggcgggctgaaaatcggcgcattaaatatgccgattgaatcaggcgttccatcagaggtcgttgatattgtgattgctattattattctatttgtggcttcaagctatgcgattcgtttcgtcatgggcaaattgaagaaaaagggggcgaactaagtggacattgtgcagattttatctatcattgtccctgccacactcgtctatgcggccccgcttattttaactgctctcggcggcgtgttttccgagagatcaggtgtggtgaatatcggcttagaaggcctcatgattatcggggcgttcaccagcgtgttatttaatttattttttggtccggaattaggtgccgccgcaccttggctttcgctccttgccgccatggcagcaggcgccctgttttcactgattcacgcggcagcggcgatttcgtttcgcgccgaccagacagtcagcggtgtcgccattaacatgctggcgcttggggcaactttatttatcgtcaaactgatctacggcaaagcgcagacagacaaaattccagagcctttttataagacgaaaatccccggtttgggcgatattcccgtcttgggaaaaatcttcttttcggatgtctattatacgtctattcttgcaatagcacttgcctttatttcctggtttatcttattcaaaacgccgttcggccttcgtatccgttctgtcggcgagcatccgatggcggccgatacgatgggaatcaacgtatataaaatgcgctacatcggcgtgatgatcagcggattgttcggcggtctcggcggcggcgtatatgcctccacaattgcgcttgatttcacgcactctaccatctccgggcaaggttttatcgccctggcagcgcttgtattcggaaaatggcatccaatcggagcactgggggccgccctgtttttcggattcgcccaaagcttaagcatcattggatcactgctccctctttttaaagacataccaaatgtgtatatgctgatggctccttatgtcttaacgattctcgctttaaccggctttatcgggcgggcagatgcgccaaaagccaatggcgtgccttatattaaaggaaaaagataaaacattctcccctgggaagacgattctcaggggtttttttctaatccaaaagacccccttaatttaattgtttattagttttttaacttaaaaaaatatgaagtgttaacgctttcttgtagactgtaacaaacaatacatgggggtgtatgacatgggagcaattccaaaaacggggacaatttcacctgagcaaaaagactcacaggggaaaaacctgtttcaaaaaatctggtcttgggaaatcggtgtgattcctctgcctttatacacagtattagctgttattattattcttgcagcctattacaatgagctgccggcaaatatgcttggcgggtttgccatcattatgattcttggtgtgtttctcggagacataggccaacgcataccgatattgaaggatattggcggccctgctattttatctttgtttgttccttcatttttagtcttttacaatgtactgaattcaacatctttagacgctgtaaccaacttgatgaaaacgtctaacttcctttatttctatatcgcttgccttgttgtgggaagtatcctcggtatgaacagaattgttttaatacaggggtttatcagaatgttcgttccactggttgcaggaacgatcgcggccgttgcagccggcatccttgtcggatttatttttggctatagtgcctatgattcctttttctttgttgttgtcccgattattgccgggggaataggcgaaggaattttgccgctttcaatcgcctactcacaaatactgggctcatctgctgatgtatttgtgtctcagctggttccagccgcaattataggaaacgtttttgctatcatatgtgcagccttaatgaaaaagcttggcgataagcgtccagatctaaatgggaacggacgtctcgtaaaatctaaaaaagcaaatgagattttcaatcaaaaagaagccgaagcaaaaattgattttaaactaatgggagcgggagttctgctcgcgtgtacattctttatttttggcgggttattggagaaattcatcttcatcccgggcgcgatcttaatgattatttcagctgcggctgtcaagtatgcaaatattcttccgaaaaaaatggaagaaggcgcttaccagctttataagtttatttcttcaagctttacatggccgctgatggtcggtctcggcatcctctttattccgttggatgacgtagcgtctgtgatttctataccgtttgtcatcatctgtatttcagttgttatcgcgatgattggttctggatatttcgtaggcaagctgatgaacatgtatccggttgaatccgcaatcgttacctgctgccacagcggtctcggcggaacgggtgatgttgccattttatcggcatcaggaagaatgggccttatgccgtttgcccaaatttcaacccgtctcggcggtgcaggcacagttatttgcgcgacagtgctgcttcgttttttcacttcataaacagaaagagttccgttttatgcggaactctttttttatttattcacaatccgaatatactctcggggaccaaacggcagatcctttgattccatctcactcattctggctgacaggtggtgctccagtaaatacagctcccactcatcactagccgccacaccgctgcgcccgtcatattgattcaacatgaatgcccctgcaaatactgagcagaataaacctgagcacatcacgacttttcttttcacatgaccagctcctttccttcagcttgatcaggattgattttaaatatacaaataacctcttttttgttagacttattttgaggtcaaaagaactcataaaaacccattacagcagttcgaagcgtggcagcttgcagaaaagtgcgatataatttggactaggtcgtttgaccgtatatttcatacatagcgcatttttcaattgagaacgagaaaaggaggtcttatctttgcagctcttacatcttgctattttatcgccttttttatttgcttttatcattcccttcttggcaaaatacgcaaaaagagtgcatacgggctggtttgtgttgatcctgcccgtcttgctgtttatatactttctcccaatgatcaggatgacacaatctggagaaacacttcgatcggtattagagtggattccgtcactcggcattaactttaccgtttatatagacggcctcgggttattattcgctttactgatcacaggcattggctctttggtcactctttacagcattttttatttatcgaaagaaaaagaacagcttgggcccttttatgtctacttattgatgttcatgggcgccatgctcggtgtcgttctagtagacaatgtcatggttctctacatgttctgggagcttacaagcctttcatcctttttgctgatcggctattggtataagcgagaaaagtcgcgctatggcgcagccaaatcacttttgattacggtcagcggcgggctgtgcatgctcggcggatttattctcctttatttgataacggattccttcagtattagagagatggttcaccaggttcaattaattgccggccacgaattgtttatcccggctatgattctcattttattaggggcttttacgaaatcagcgcaatttcctttttacatctggctccctgacgcgatggaagctccgacgcctgtcagcgcttatctccattcagctactatggtaaaagccggcatttatgtgattgcgagattcagccctattttcgccttttcagctcagtggttttggatcgtgtccctcgttggcctctttacgatggtttggggttcattccatgccgtgaaacaaactgatttaaaatcgattttggcgttttcaaccgtcagccagctcggcatgatcatctccatgctcggagtcagtgctgcggcccttcattacggacatacagaatattatacagttgccgctatggctgccattttccatttgatcaaccacgcaacctttaaaggaagcttgtttatggcagtcgggattatcgatcacgaaacaggcacacgggatatccggaagctaggcggcctgatggcgattatgccgattacatttaccatttccttaatcgggacattttcaatggccggcttaccgccgtttaacggatttttgagtaaagaaatgtttttcacaagcatgcttcgcgtgacacattttgacctgttcaccgtgcagacatggggcgttctgttccctcttttcgcctggatcggaagtgtatttacgtttatctacagcatgaaattgctgtttaaaacattcagaggaaattaccagcctgagcagcttgaaaaaccggctcacgaggcgcctgtcggcatgctcgtaccaccggtcattcttgtcgctttggctgtcagtctcttctttttcccgaatatattgtcgtacagcctgatagagcctgcgatgaactcaatctatccgacactgcttgccggccatgagaaattccacgttcacatttcacagtggcatggggttacaacggaattgctcatgactgcgggtattgttgtgatcggaacaattggttatttgtcgctgaataagtggaaaggaatctataaactgtttccttcgaaactcacactcaatcggttatacgataagcttttgactctgatggagaaaggctcttaccgggtcacaaaacaatatatgaccgggtttttaagagattatttgctgtatatcttcgctggtttcatcattctgataggcggagcttttgccattaaaggcggattttcatttaaaacggaaggcatggctaaaatcggtgtatacgaaatcattttgacgcttgtcatgatcagcgccacagtggcgactgtttttgctaggtcaagactgacggcgatcattgcactcggtgttgtcggttatacgcttgcattgttttttgtcattttcagagcgccggatttggcattgacccagctcgtcattgaaacgatttctgtggcactgtttctgctttgcttctaccatttgccgaaactgaggctgaaaacaaaaacgagaacgttccggatgacgaattttatcatttctttaggcgtcggtattattgttactctgcttggtatcgcatcctcaagccagcggacaaaagacagcattgcgtccttctttgtcaaacacagccacgatctcggcggaggggataatgtcgtcaatgtcattcttgttgatttcaggggatttgatacaatgtttgaaatcacggtattaacgatagccgctctcggcatttacagcatgattaaaacaaaagtaaaagaggaggggaaaagcggtgaatgaacaaaaaacaaatgacttgattcttcaaaccgcgacaaaacttgtatcctttatcattttgcttttctctttctatttatttttatcagggcataacgcgcccggaggaggctttgtcggcggactgatcacgtcctcttccatcgttctcttgctcttggcgtatgatttaaaaaccgtgcgttcccttttgccggtcaatttcatttatgtcgcgggagccggccttctgctcgctgtattaacaggcgttggctcctttgtcttcggagctccttttttaacccacacattcggatactttcagctgccgatccttgggaaaacggagctcgccacagcgacgatatttgatttaggcgtttatcttgttgtcgtaggcataacgatgaccattattcaaacgattggagaggaagaataatggaaatcttaatggctgtattagccggtattatttttatggctgctacgtatttgctgctgtctaaaagcctgcttcgcgtcattatcggaacagcactgttaagccatggcgttcatttaatgcttttgactatgggaggattaaagaaaggcgccgctccgattttgagcgagcatgccaaatcatttgtcgatccgcttccgcaagccctgattttgaccgcaattgtcatttcttttggcgttacatcattcatcctcgttatggcctttcgcgcttatcaggaattgaaatcggacgatatggatcaaatgaggggaaatgatcaacatgaataattttgttattttgccaatcctgatcccgcttttgtcggctattcttctgattttcatgacgaagaatcttatgctcatgagaatcttcagcacggcggcatcggccatcgggattgtgattagcggcatacttgtacagactgtcttcacaaaaggcatccagacactcagcttaggcggctggaaagcgccgtacggcattgtgcttgccgcagaccaattcgccagccttctcgttctcacaacagcgatcatcggtttattggttgggctttattccttccgttctgtcggtgaaaaacgggagcgctccttttactactccggcgttcagttcttgcttgccggcgtcagcggagcgtttttaacaggcgatttatttaatatgtacgtattttttgagcttctgcttattgcttcctatatgctgattgtattaggcggtacaaaaattcagctgcgggaatcccttaaatatattgtgtttaatatcgtatcgtctgccctgtttgtcataggggtcggctttttatacgctgtaaccggtacgttaaacatggcagatcttagcatgaaaatcagcgaaacaggacaaaccgggctgatcactgtgattggtgtcctgatgcttttggtatttggcatgaagggcggaatcttccccctctacttttggcttccaggctcttattacgcgccaccggcagcaatctccgcgttgttcggcgctttgctgacaaaagtcgggttatatgcgattgcgagggttttcacattgatttttattcacgatacagcctttacccatcagctgatgatttggctggcggcgctgactgtgatttttggtatcatcggttcactcgcttattcgaatgtcatgaaaattgtgatctataacattattaccgctgtcggcgtgattttgttcggtgtggcagtacacaccccagcatccattcagggcgcgatctactatctgattcacgatatgctgattaaaggcgctttgtttatgctggcgggtacgctgatcgcattgactggaactgcgagcctgcataaaatgggcgggctgatcaaacgctatcctgttcttggatggatgtttttcatttccgctatttctcttgcaggcattccgccactgagcggatttgtcggcaaatttaaaattgcggagggcggcttcgcagaaggtgaatttacgatatccatgctgattctgctttcgagtctgcttgtactgtactctgtgctgaggatctttatacatgcgttttggggcgaagaaaaagaaacgccaaaaccaaatcatcgaacagctaaaggacttctttatccggcagctatttttctcttgctgtctcttctcttcgggttgggtacagaatgggtgtcgccttacgttgatcaagcggccgagacgctgctgaatccggaaaaatatatcgaagctgttctgaaggagtagatcgcatggcttttcaaattttattaaatgtgtttctcgctttttgctggatgttcttaagcaacagtccaagcgccgcaggattcattacaggctatattctgggaatgctctctctctttttcttccggcgctttttcactcgccagttttatctatggaaattgatttctatcatcaagctctgtttcatttttataaaggaactgtaccttgccaatgtcagtgtgatgaaatcagtcttatctccaaaactgaatatcagaccgggtatttttgcttttaaaactgaactgacgaaggactgggaaatcaccctgctttctctgctcattacattaacgccgggaaccttggtgatggatatttcagatgacagaacaatactttatattcatgcaatggatatcgaggatgcggaaaaagcgatttttgacattcgggagtcatttgaaaaagccatacaggaggtgagccggtgatgtttacgctgatcctgcaaatcgcgctcggcattatggcagtgtctacctttttgtatgtcattcgtgtcattaaagggccgactgtgcctgaccgggtcgtggctctggatgcaatcggcatcaatctgatcgcaatcacggcgcttgtctccattttgctgaaaacaagtgcgtttttagatattattttgctgctggggattttatcgtttatcggaacgatcgcattttccaagttcctggagaaaggagagattatcgaaaatgatcgaaaccgctaaggtcgttgtggctgtattcattttgctgggtgctcttatatgcctcattgcttcatttggcgtacttcgccttcccgatgtgtttacacgcgctcatgctgcttctaaaggctcaacattgggtgtcaatatgattctgctcggtgtcttcttctatttgtggtttgtgacgggggagctctccgctaaaatcctgcttgggattctctttatctttattacgtcgcctatcggcgggcacttgatctgccgtgctgcgtataactccggcgtcaagcttgatgagagaagcgtacaggatgactataacggaatcagaaactttgtgattaaacgaaaagaggattcttatctataaaaataagcagccggacaggcagagttccggctgtttttttatttcttgatgacagccagcgtgcatctggatatacagatcagcctctcttgctcgtcatatatgtgaatgtgatagacaatcgtcgttctgccgatatgaacgggctcggctaccgcctttaccgttccttccttgacagattttaaatggttggcgttaatctccaaaccgacacaagcctgtgttgaatgatcaatcaggttctgtgcacctgcgctcgccgctgtttccgccagggccactgaagcgcccccatgcaaatatccgaacggctgcaccgtccgatgatccaccggcatgaccgcaacgcaacgttccgctgtgttttcaacaatctctataccaagcgcttcaagcaatgtgtgcttcgtatccatcatctacacccccaatatttaaagtacaccgtctgatttcgcaatcaaaaccgcttccgtccgggaaccgacattcagcttattaaaaatcgatgtcaagctgtattcaatggaccgcttgcttaaatgaagggcatctgcgatttcttggtttgtaaatcctttttcaacttcttgaagaatcaggcattctctaggtgtgagcacatcttgttctttttgagaggaaggagccggctttgttttttgctgagtcatcagctgtttaaagtaagcaaaatcgactaaaatttctccattgagtacgtggtatatgtattgggtgatcttttctttagattccgttttgctgatggcaccgtgcagacccgcacgaatcgcttcctcgaaataatcctcgacctcataaccggtatacacgataattttacaatgaggattctcttgtaaaatctgtttagaaagctccatcccattgacctcgccgcctagattcagatccattaaaatgagatcatatgacgagaaatcatgctgcttgataaactgttcgctcggttcaggactgagacaatcaacagacaaattcgaatccgtttccaaaattgtcttggtgccttccatgacagccggatggtcatcaatcactagtatctttttcatgttttcctcccttttactcactcttttccattttataaaaaagacttggcctgtgccaagtcgtttccgttataaatccattacaattcgatttcaatatcagccttaaagccctttccttcacttgtttcaatccgaaggcgcccatctaaagccctgactctctccttaatgccagaaagccccatgctcatggaatgctcagtatttttttcttgatcaaaccctacgccatcatcctcataatgaagaacgattttgttttgaatactgatgagcataatcagcacatccgtcgcctgagagtgcttgaccgcattagacagaaactcttgaatgatccggtacaaattcagctgcgaatccagatcaagggaagccgtaaatctcccggtatttaaacggatatgaaacggaacccgctcctgctgctgcgccaccagcttcgacagcgccttcaccaatccaagatcatacagaagctgcggccgcagctcatgacacgtctccctcgtcatcgaaatcacatcagacatctgctcattcatctgcacaagcttgtcctgcacctcttcacggcacggattatcatccttcttaaaatcacccaaaaacagctcacactggcgttttaaggaaattaaatcctgaagaaccgaatcgtggagatcgcgggcgagatccgagcgttgtttttcctcgatcgtgtacatgagttttttgagccatacggggttggattcttgttgttttatttcttctaaatgactcatcagttcttcgattttcatgacgttttcgatcgatacgtttgtataaaaagccaaagttttcagccaagaaagttcttcgagtgtgagacgaggcgtattcattttagataaacaaaggatcacaaatgatttaccaccgcgttcacctattttcatgacaaagcctttattaaattcaacgattttccctatttcggatgttacttttctaaattctttttgatagactttttcaaatgaatttacgttctcatcatcatatagtttaatatttccgtcagctgaaacttcatatacatgtgctcggctaacaagagaaacctcaagtatagtatttttcagttcttcaaatacttgagatagggaagtagagtctcttatcatctgcgtgaatttatatatactgtcttgataattgaatttttctgagaccctttttaatctaaatctgaaatcaagtacttctttataataaaagaccgccaacatgataatataaattaaaaaggttagtttaacactataaaaatcactatcaggactactaattaattcaattgtagagattagaataattgttggcgttagagctaaaaagccatagtaccttaatctgcttaaaataaaatctacattatagattttatttgtcatgaattgaaataccaatgagaatggtatcagcagcataaatgaagccgctaaaaaagaagaaacataatgtgcatttaaaaacacgtaaggtatcaaatataaacacagaaaaggcgaaaaagaaaagatattaatgatagtgagaaccttaataatatgtgcttgttcagtgtctttatttttaattagtatgatactaaaataaacccctactataataaataaaaagaaaaaagcaagtaaatttaatttaggaacataatctcgaaagaaaagatgtgaacgaaaaatttcacaaactacatttatgaccggaatcaaatataaaataaaaactttcttattaaataatttggttcctaattctttgaaatattgataaagaaagagaagatagtttagcggaacagatattaatgttaccaccattataagcctgctcagcatatctcccttagcagaccctccagcacttataaatgcaatagaggcagacaacagaaagataattaaaactacagctgagagaaggttctttgattcatttatttttaatataaaaaagcaacaaaataaacaaacaatataaaatattaacggtattaagtaagtagtgaaatttttatcattaaataaggtcattttcaactcaagattatgtccatttctttccacaatcatcgaacttacattttttagtttgttcatttttatttcgtttgtgtttatctttttattattaatactctttacgatatctcctttttctataccgctgtatgaagccattgaaaattcatctacattggtaattacaatatcgccattttttcctttagagacagttgcccctactaataaattattattactaatataagtcaaataaataacataaatcaaacttaatacaactaacactacagaaattttgttatttctagacttcatttaaacctcagtacttccaatctagcattgaataaatttctaatcctttaaaaccatttattatgcattcagattgatcattatcaacacccaataaacaagcatttccttccattacttcccttaaaacatttgggtatttaattaagtatcctaccatttcttgcataataaatcccctccttatttaatcataacagacaataatttttcagttttatcttctcctagttttaattgtgacatttcattttttattttttggagagataaatgtttcatcaccagtaaatattgtataacgcctgcttctgtcaattttcgcttcaaagccttagtattaattgaaacaaattcctctggtttttgatataaacttagtagctccgctgaagcatcgttaaattgtttctttaagtataagtatgccaatgtattttttttctgaacaaaatcgttatttaagtaaaacaaacctttataatcattatcgatctgtgaaataatcccaagttcataagaataagaagccacgatgggatgatatttgcctgttgccaacattactcccattacacaaggcaatgccgttagcgctcctgatttatttttgatcatttcaagacaggcttcttcagtttgcggcgcattcacaatatcatcatgctggccttgaattgattgtaacgcaaaattcaatatctcttgtgaaaattctggttcatgactagcttgacacatcacttgtatacttagggtgtaaagagctgtaactgcatttaaagcgattgacgagtcaatcttcatccagacagcacttccattatcttgatcctctaagtcatcataaatatcgaatgagagtataagcaattcaattccggcagctagccattcgattgctttttggtcctgaccgttaaaagctaaataatgatgaagagccaaatcggcaaactcaaacgtatccttagactcaataaaattctgaagatatcgttccaagtcctgattcattattttttggcttacaatctccttcattttctccttgatccggacagaatctaaacatatctgctcaataacgacttcccccctcccattccattttactaaatgggacatttaaaggacagcaggtttttcgttttttaacaatcatataatactttatccatttattgtatcggtagaacgaaaaaaaagacttgtttccaagtctttttcacgaaattttcattgcataattgtatttatcgagttgatcaatgcttttgttaatgtttcgtaatgaatctgtcgtttctttaatatcaagttcgagtcggaataacaattgttttacttcttcaagtttcttttccatcgtttccacactcctttttttgaaagatcaatgaattgtgtatggtgaacgagtcctaggtatttgatctgttactaatagtgtatctgctttcggctcatttttcaccgaaaagtatgcaaaaaagtcctgcgtgacaccgcaaatctcaataggtccttatactcaaaggaatcacaacaagaacgggactatctttctatgcgaaagagcgtttatatgtgctgaaattgagaaagattcttaatctccttgattttaacgggtttcgcattttcattaagcaagactatagtccttcataccgtattttcaaaattgaatatgcgattcttggcgtttcctgaccgacaaacaccgaaaaagaccgcaacgctaaagttgtggccttttcgctttgtcatattcggcaattagggatctatacatatagaaacatccttttttgcgaggtgctcccatgagatatcgttatccctggttttacgtgtatccgtatgaggtacgccgtccgcccgctcctgccaacaatattgatacctttatccgttcagcgaggcaggccgcagggatatttgcggatgcccagctcgttctcggccgcattgcgggctcgcgggagctctcgcgccgcattctgacggcagccgagcagtccgataaacaaaccatcaagcgcctgatcaaacaattgggcgtccggcatgaagtggatacggtctttaatcccgacggcatctatatcagtcttatcggaacgcaaagccgaatgattcttgctttgcggtggtcagaggaccgcaatcattttgcgtccataagattatgacaccattccagagcctcaagataacattcatacgcttcttctttgtcgagttgattgcctaattccgagcaagtgtcccagttgttgctttcaattaatttcacaagctcaagcatttggtagtagtcgttttgatggcctaataatgcttgcccgacttcatcttttaaaggcaattcttgaacaatttcctctatttctctatgcaggagggtgtctatgagagaaaacattccgatcagcatataagaagcaggctgcggccgggatgtctttctcgccagcagttcgcaaagctttgctcttatcaaagaaatcttaatgatttcgtgcttgctggaatgccctttcctgcttaaatccttaaaggaaagaatatagatccaccgtttgatttcattaaatcccagcagcataatggcctgttgaatgctttcaattttctggctcaaacggctgtgggatgagtttaaaaattttaaaatttgataggacagtgataaatcccgctctatgtactctgtcacacgctttatgttaggctgctctttactcagttcgttaagcagttcatagtaagaatagaaatgagtcgataggtcatgcccgctgatgatgcgcggctcgctgaaaaagtagccttggaataattgaaagccgtcttggaccgcctgtttatattcttttcgggtctctactttttccgctaaaaaaatcaggccgcggcagccgtaggtttgcaaaattgttctgcgttccattcgtgttgttttgagaaaatcaattttcaatatatcaatatagctcatgagtttttccagtaagtcctcatcttgcgggtttattgcataaaaatcatcaagcgccagcatataccccatttttttcaattctttgcatctagaaatgagggccggcgtgatcggtatatcttcaaggatttcaatgacaagctgtttcggattgaaggaggtaggaagattcgaaaacatcaggctttccgtaaaattaacaaaacagcgtttcccttccgtcagcttctcaattccgatgtttaaaaagctgttgatcaccaaatctgttgttgcctgatcgccgtctttagcgctatacacgttctcttcgctttctctatacagcagttcataagcaacaacctgttcttttctattaaaaataggctgtcttgcaacaaacaccctcattgatttatcccccttacaatacgcgcggctttcacccctaagtatatcaaataatttgacgaaaattgtctaaacatgaaaaataatatatacataaagaaaactggcccttcgtgaacgaaaggccagtttttctttattcttcctcaagctcttcttcaattctgcttttcacttcgtggatccgctgcattttattgctccagcagtcctcgcttaaatcaaccgggtattcctccggcttgctgattctcttatattcctcccaaagcaggctgaggttatcctgcacatactgctgtatgtctgaaatctcagggttttggtagcaaagaatacccttctcaaaaatcagctcatgaagatccttcgcataaaaattcgtgacaaatttgctgatgaatgtatgaaccgggtggaacattctgagccgcttctgatcattcacctgctcatcataaagcgcaatatagtcgccttcagaatgatggttggactgattaataatgcggtagactttctttctgcccggtgtcgtcactttttcaggattggacgaaattttgatcgtgtcaaccattttcccgtcttcttcaatggcaacgagtttataaactgcgccgagagccggctggtcataggcagtgatcagcttcgtaccgacaccccagacatcaatgcgcgctccctgagcctttaaattcataatggtgtgctcatccaaatcgcttgaagcaatcaccttcgcatctgtaaatcctgcttcatcaagcattttccgggctttttttgacaggtacgccaaatcgccgctgtccagacggatgccaatgaaattaatgcggtcgccgaattccttggcaaccctaatcgcgttcggcatgcctgaacgaagcgtgtcatacgtgtcaactaagaaaacgcaatccttatgtgtttccgcgtattttttgaaagctgtatattcatcgcggtaagcctgcacaagcgcatgcgcatgtgtgccggaaaccgggatattaaagcgctttccggctcttacattgcttgtcgcgctaaagccgccgattaaggctgctctcgctccccacatggccgcatccatttcgtgcgcccgtcttgttccgaattcaagtgcaacttcatcaccaatgacgcctttaatccgggcagcctttgttgcgattaatgtttgatagttcacaatgttgagcaaagctgtttcaatcagctgcgcttctaccaggggtgcctccaccctcataatcggctcattgttaaaaacgagctctccttctttcatggagtaaagtgaacctgtaaaagataagccgcgcaaatattcaataaaatcttcatgatacccgagttcatcctgtaaataactcaaatcgctatccgtaaacttgaaattttccaagtattcaatggctttttccaagcccgcaaatacggcatagccattttcaaacggaagccttctgaaaaacagctcaaaaatcgctttcttttcatgaatgccgtctctccagtacgtttccgccatattgatctgataaaggtctgtatgtaatgacaggctgtcatctttaaatccgtactctaacactgtttttccccttccttactctgccacttgcgctccgatgctgtttgcaaaatgggaaagagcccatgcgtgcccctcctgattaaagctggcaacagcttgtttatgcacaacaatcccaaaacctttgttgtatgcgtcaacagctgtatgcaacacacaaatatctgtgcagacaccggcaaggtgcagttcgccaatctgccgctctctgagtttgagctctaaatcagttcccgcaaaagcagaatatctcgttttttccatgtagtaaacattaggctcatgttcatgtttctgatatagaggcaaaagctttccgtacagatcttttccttccgtgccttttatattatgcggaggaaaaagacgggtttcagggtgatattgatccccttcatcatgagaatctactgctaatacgacgtaatcaccgtttgtgatgaattcttcagttaaattgacgatcgcctcttcaatcattctgccgggctccccgcaggtcaattttccgtcactcgccacaaaatcattcgtataatcaatacaaataagtgcttttttcatagccggcctccccgccatcagtatgagaacattatatcttatctccagttgtaagtgaattgccatgaacaaaaagacaaacggtccgtttgtctcttaagatttcagcactgaccgattataaatgtcgtcctgaatatatatcaattcacgattcacagcgatgtcagccgcaatgacgatgcctaaaggcgtatgaaactgaagatcagatacaatcttgaagggcactccgtaccggttcgccatttggatataaggagagtaagactgatactgaagctctccattaatcaaaagggtgacgttatggctgtttttcagctcgtgctccgcctctttatacggtttgcttctaagcacctgtccttttgtcagtgccaaaacgactctttctcttagagaacctaaaaacaagtggcgctcgtcaggctttgtctccaaaggcccatacattccttgctgcaaatagagatccattttatcttcactcaaaagcctgtcctcccgtcttgtttgtcttcattatcacctgatcaggcaggagctaaactttcaagcgccgtttacatttctgttacccaatgaatgatttttttggccagctcaccagcagggatttcctctgtatgccggcgcaacgacgcttccagccgttcaggcagagttgctttatcttcttcataggaaatgatcgtgctccactccagctgcggtaccgctacaagcgtgcgcagttcttttctgttttcatgcagatacacgtccgtgatcattccggtttgcgtattgatatttgcttttctgattttcataacatgacctctctattcaaagactacccatattatacaataaaaaagcaacagcctcttgtgaaaaggctgttacccgttaaacgaaactgtttcatcagtgatatcggcatctttgaagagagttttactcgtttggttgttaatcttcacaaaatcaccaagctgaaatgtgcctgaccccgcccctgaatgagcgacgcttttgggcgaaatcgcaaatacgtctccaaagcttgccgcggcattatccgtaactgacatgatataaatcggccccacaattgcaggcatttccccacctccgcattgatttacagcatcatatgcaaagagccgataatggtgccctcctattcagctggctttgctttttcttcgagtcgtgaccgctggcgcagcttgatcaaacggacaatattcaggaagaacgccttcactaccgcataaaccggcaccgctaaaatcatgccgagaattccgccgaagcttcccgctccgattaatagcaaaataatcgtaagcggatgggtattcagccgctttccgatcacaagaggagacagcaggtttccgtccagctgctgaacgatgacgaccacaataatcgcaaacagcgctttggccggcgagtccataaaaccgacaatgacagccggcgcggcaccgagaaaaggcccgacatagggaatgatattggtaatcgccatgacaatcccaagaatcagggcatacggcagtccggcaattaaatagccgataaaacacgctgttccgacaaaaagacagattaacagctgcccctggaaatatgccgcaagcgtatcggataaatctttaaaaatctttaagccttctgtccgataagaagccggtagaatttttactgccaaatgcggaaagcggtgtccgtctttcagcatgtaaaaaaggataaatggaacagtaataataacaagcgtgatgtttgtcacgacaccaaacaccgcagataaactggacgtgatattttgcggcaggttttggagaaaacttgtcaatgactgttcaatttttgatatcgatacataatcctggttcatcatccaggtaaaccattgagaatgggacaaatcctttgtcagcgcctgaatctgttttatataatcaggaaggttgttaaacagccctgtcacctgtgaggtgatgataggtccgactgacgctgaaataaaggcaagcaaaccgataaacagtaaatagatcaataggatggataatgtccgcggaatttttttctcaagcaggcggacgaccggattaaatatgaaatacaaaattcccgcaattagcatcgggaaaaacaatgtcgagataaaaacaataaacggctgaaatacaaatgaaacttttgttgctacataaataatcagcaaaacaaataaaatctgcaatgtccaaaaatggacttttgatttcaacaagctttgttcctcctagtttttctttgtctgtcagataaaagaacttataccccatcattgtaacaaaaatgaacccatatcagaactcttaatataatgaaaggagtgttggtgatgaaggccgtgacatacgatacagattcagaactggcttatatctatgttcttcctccgaaaaggaacaggaatatacggtctgaggagcttaaagtcaatgattgtatcctgctggatatcgaccaagacggcaaaattgccggattcgaatgttttggtgaggcagcacacctctgtgccccatttgccgggaaatcccggctatatgtaaaagattcagacggttatcattttcgggtctgccagcatgcttcagtccgttcctgctatacagtgtacggcgtcactttctgtttttcagatggtgactatcaggaatttgccggttttgaccttgacggaacaatgtatcatagtgcgtttttacagcgcttaactgaaaaataggacgtcccggtgtacgcctatttttcatgcgcaagcactgttagacccgctcactgtaatctggggtgacggaaatcatgtgctggattctgatcaaacaaacagaatttcgggctccttcaattgtgatatggtcaggtttaacatcgatcagtctgcctctgaccgtatctcgtactgtctgtataacgaaccttgagccgatgagctttttaatggtctgatagacataaggatcgactaaagagaccagttgcggactaccttggttgaccatatttttatcccctttgtgtgttttatctcagcttatgccgcgcttatggataatgacacaggcttacctgataaaacaaaggggtgcggagattttaggagaatacgtttggaagcggtgtaaaggaagtatcgatgaagcggagacagcgaagaaagctggcgctgttccgtacttatacaggctttatcacggatgcctgggcttggtcgattaattggtccagcttttctattttttttcgtgcggttgaaggatcaatttggcggtaatgatgatggccgcccggctcttcatccagttcgtccgcttttttgacaatctgctgcagtgtgtttttatctaattcgccttcaggcaaataggaatctgtatgaagcaaaatggctagtgcaatctcttttgctgctttcggttcctcgccaagccgaatcagaagtttatgcgcccgttccgcccctttaatggcatgaatgtcatttcttttgtatttctcataatcccactttccgtctgtataccattcataatggccaatgtcatgaagcagtgccgcttttgctgctaaatcaggattaatgtcagccttcacagacagcctgtatgcatgataagcgcaggcaatcgcatgtgccacgccggaacgctgaagatatttttgtgcaattggatgggtgaaaacatccattaatgtaacctttctcatggaaacccctcctttagatatttttagaatcctaacataatttgcagagaaactcaattcttatgtcacatcattttgatcttcttatcatcattgttataccctaaaagcaacgtttcagtcagtatatgcggctgttcaataaaatgcgctggctgtagccttttgtataaaaaaaagagcagaaaatatctgctctacaaaaactctttaatatcataaatgcggccgttttccgtccctttttctagtaaagaaagcagcgtgccggcaataaagtccggactgcgaaggcttcctgtttcatttaatttccggaatcgttcaatgtggtggaaatcctttttcgatgaagaacggatgacggcctgcatctcagtgtccatcactccaggtgagaacgaaatcatgttcactggcagctcttcatcctcctgttcaaatccgaatgtcctcgtaaacatgtcgagcccggcttttgaactgcaatacgcgctccatcccttatatggatttttggcggctcctgaagtaatgttgacaatcgtctttttgccgctgtatgaagcaaaccgttttgtaaacagctgactcaaaagcacgggcgcagtcaggttcagctgataatggcgctgaagctcgtcaagagacgcttcgccggcacgtttgatcggcgttaccattccggcgttattaataagggtaataccagaataacgatctgaatcgatggatgagagcaatgtttcaaattgctgttcagcttcttcgagattgatgaggtctatttgatgctgcgttagtttttcatgagagacatccgttttcgttctggataaggcatggacttcatgccccttttctaaagcctgtaatgcaatggcttgacccagcccttttgacgctccggtgatgatataaagttccattggaaacctccttttccgttattattgtacggcaccgcttttacacaacacaagcacgcggcctacgctttcttgttttcctgcgctgtgacttttgggatgaggaacacgatgcctgcaattccgagcaggatcagtacgacatagatcatcggcagcagcaatgatgatgtttcttgttcatcttctgtttccgttgatgatgtctttgttattggtttatctgcaaatgtaattccaagctgtttcgactgggccgcaatcgtgttggaatcctcggcatttgttgatgtaaacaaatcttttatcagctcggcgtccttgtccttcggtttatcaaaagtgatatccttttgttcctcaggcagttctgttttttcttcatagtaggtatcttcatgcaaataattcgtatcgatttcgatgtcttttttctcatactggtttggcgcgacatctgtattttcttcagtttgggcagcagctgcagagggtatgaaaagggaaaaagagagcatacaaatcatgatccccttttccatgctgcgattacgcttcatacgtttcatcgctttctgctgtgtgttcagccatcagccggataatcagcggcagagccgcggcaatcaccgtaatgatcagcagaactgttattcccattgtaaacaagtgcccagtaccgtactggatgtcgatatatactttcgaaaccggatcttcaaatgtaaagttcggcatgatcaaatcaataagcggtgcgacatagaataggatcattgctgctgaagcaacccagccagggattgatccgaatctgaatgccgtccggatgaaggcagagcttgcgaccagcaatagaatcgtaaacaccgaccacttaatcgtctgatcgtccggcagtgaataaatattcaagccgaacaagctgatcataagtccgacaaggatattcagaattccgaataacgctcctttgacgagaagcggtgcgttttggtaatacgagctgaaatagccgattaacagactgctgatcaacacaatgacaaggatgacaaccggaggtaccgtctgaattttttcttccggaacctctccgctgattttaagcggattcgctaagtaatcatatacatagccattgttttgcccgtctactaatgtatttccgagtatgccgtatacgtcatttcgcacgagtttcgtggaggcgacatttttcccccagttgttgtttaaggtgtcggctttcgcttgaacatcattgacgctttgctgcatgttggttgtgtaatcaatgatgccggactggcgatcagacaatgaacccatcatgtctgacatttgcagcacttcctggccgaccgtatcttggacactcagtgccatggtgccagacagcccatcgttgctgaacgtcgcagattcctgtgttgcgcccgttacaagctgttctgacgcttttgcggcactttcagagattttcgtcagttcgtcgagaacacctgcttgagagtcacggatatagccgctgtagtcgtccgcaaatttggtcatgccgtcgatgaagctgttaatatcctcatctgtttgcatcgtgttgtttttgagagcttcccagctggctgattcttcaggtgtgagagccaggactgatttgacgttgccctgctggccgtcaatagcgccggcttttgcagcactgtcaatcgtaccggataatacagagtcataaacagacaaatatttatagtatctcattaaagcggagatgctttctgtattgatttctcctgaaaattgaagctgatctttattttcaagctcgcgaatcgcactgtaaatcccttcaaactcccgcttccgtttcgcttcgagattttcaagtttaccttcgagctttttcactttgtctttcaggtcatcaatttcatcagtgagaccattcatttgctctgttagttcctctaacttctttttcaactcttcattatgagcagtttctttttccttcagttcttcttcaatttgcttgattcgctcagacgctttgctgagctgttcttttgctttggcgatatcagaaatgtcatcgtttcctggttgctcttggtccccaggctccgtcgtatcttcgccgctaccggtatctcctgaatctccggttccgccttcatttgccagcttgataaattgaagggctgaatcagaagatgcagtctgttcggcagatgtgcccgtttcagtttttccgctgtcggacgcaccatcagaggcatcgccgttctgctcctgaccgtctgttcccttctgctggtcttgatcctgagtactgccgtccgtttgtccgtcattaccggtatcactgctgttattgtcgttccctgtgtcgccctgtgtatcatcgggctttgtactgcccccgtcatcaggtttttctggattatcagtggacggatcgtctggttcagtacccgggtcctccggtgttgggtcctctttttcaggctccttcagattgtctgaaatatcctgaatatcagcagcgatatttttcagttcttcacgctgtttttcaagatcaattttgagttcttcaggatcttcttctttagggtctttatctttatcattgttgtcagaaccatcgtctatgactgggtcgtcccctttcgcaactgtcaatgcctgacgtgccgggacaagcaattcatacacctgatttagtgcagcctgtcttgatgcggcctgatattgttcgattaaattactttggatttttgccatgccaagttcctgctgtgacacttgcccttccctaatttgctgggcgtttgccagcacattactggtttgtccgagctgtgacttcgcttggccgatcccagttgccaatccgctcatgcgttcgctgaactgattcgccttttgctgtgcctggatggcatccagacctgtccggatttgctgctgtgttgaatcctgggctgccaaaagcagctttttctgattttcttgatattccttgtatctttcaactgtatcaatgaattctttcagcgtatttttggcttcctccgctgtagaagctttttcttttgtcgtgccttgcgcttcattcattgatttcttcagctcatcgattaaatctttttgctgtttgatttcacctgctaaatcattagagcttggtttgtaaaagttgtacatgacattctggaattcagattctttattgacgattttgtcaaattctcctctgatgttgtccactttttgcgacacaaagttccagtataaggctgacatttttttgttcattgtcttttgggcatcctcaagctcacgctgaactttttctttgttgaccgcattcaggttatcttgaatgctgaattcaagcgttgctttttgtggatggtctttgtcatagctcaaaatgttttttgagaagtctgagggaatgtagacgatcgcatcgtatttttttgacgcgagaccggtctcagccgcgctacggtttacgaccgtccacgaataatcaggacgttcacccagaacagccgctacttccttgccgaactgggcggatttgtcctcttcatcagactttacctcatcactcaatacgccagtgtcttcattcaccaccgcgatttgccgggtggaattgactgcttttttcgtcgggtcgtctccgataaatcggaaaaacaacaccggcagcagcaaaatgatgatgacggcggatattaacttgatcaagctttttcgttgttctgtcatctagcactctccctttcagcagaacataaaggaatttgaactttttgctccttcccgttttccacaacatatccgaagcccggctgaatctcaggctcctgtctttggtacgggagaggaatgacattttgctcagactttttcatcagcagaatcgcgtggcggatttgcttcatctcagtcgtcaaggagtcatagccttttgagaattcgctgtggtttccgcccgggataaagctgaacccaagatgagcgtatgatttcatgaagttagcgagacgatcttgtattctcgtatcaatcgtctgctggaatctcgttatcccgtcaatcatcagcaccacttgtgagaatcgaagattttgcgcgtctccttggcggacggcttctacatacatggcttctcttgttttgaaaatgtcttctgctgtttcaatccactgctcaatatcttctttcgtttccaaatatgaaacatctgattccttcgcataatgagataagccgcggtcaatcgagtcaaacaggccgatcatttcggtttcatcatcaatcagatgttcgagcatgacttttaggacgtttgttttcccgcgctgagtctggcctaaaatcaggcagtgcttatgcttgcccaaatcaaaatagactgggctgactgtttcttcatgaagcccgatcggtacagataaaggcttgcgttccagcttgaagcggagagaaaattctctcgttgtcaggctctcaggcagcatcggaatcggtgccggctgctccaatgaagcaaatcgtccttgaagtttctgtacgtctgatttcagctcgttgaacatgccgatatcatcatcggcgtcaacaggcaggaacatttgcgcgaaataaagctcttccttttgaatgatgacgcgtcccggaatcggctcaagattgaatttcggacggccgtaaatggaatatccttctgattgatccatgagataatggacaacctttgttttcaagttatttaacaatgactggcggacagcattcacccgcgttgctgtcagcataaagtagatacccaagctttgtccgtctctggaaagctggacaaattccgattcaagctcatgcatctcatccttgactatgtcaaagttgtcaatggtgataaaaatgaatggaagctcttcttcgctcagcgcattgtacattttgatgtggctgatttctttttcccggaacaaacgtttacggcggtcaatttcttctttgatgcgaatcatgaacttttcaattttccttgactggtccatcaggaagtaatccgcggtatgcgggagcttcgctaatggcagcagcgttccgtttccgaaatcaaagatatagacatgaagctcttcaggtgtgtatacgtccgcaaaactcatcaggaacgttgcggctgcaatcgattttccgtagcccgaagagccgaagatgccgatatttccatcttccatcatcttataagcaattggcgcctgtctttgcagatcaggttcatctacatacgcaaagtggaaatggtctttttcgtttgaagggaaaagagtgcgcggaatacgttccgcaagcggcggcagccaagggcttggcagcttctcaattcccatttcatcttggatgcgttcaatttcgtcaactacagcttcgatttcggtttgaacgtcttttttcgcgatatcttcggtatcaacctcagaaagcgggatcagacccgtatctgtaacgatcgcgatttcatcctcggtaccgtagacttcctctaagtaaggcgccccgctccatgcagattggaaaagctcatacacttcattgtttccgacctgcaaatagccgcggcctgttacggtaatgtttgcggcatcgctgtttttcaaaatttctttactgtcggtggcatcctggaccttgagcgctactttaaagcgcgagttactccagatctggtcgtcgatgatgccgcctggcttctgtgtcgccaaaatcaaatgaactccgaggcttcgtccgatacgcgcggcactgacaagctccctgataaaatcaggctcctcgcttttcagctcggcaaactcatcagaaattaagaacaagtgaggcatcgccacttctgctttcccttgcttgtatagctttgtatagtcattgatgtgattgacttgatactggtcaaacaggcgctgcctttttttcagctcgcttttaatggaagcaagcgcacgcatactgaagtttttgcttccttcaatatttgtgatcgtgccgaggaggtggggaatgttgcggaacggctgcgccattcctccgcctttatagtcaattagtaagaaagccgcttcatgcggatgaaaatgcactgcaagtgacaagatgtaggtctggagaaattcacttttccctgatcccgttgtccccgcaagcaagccgtgcggaccgtgtgctttttcgtgaaggttcagatacacaatgtcatctttccctttatagccgatcggcactgacagcgacttcgacgattcacttgtcagccatctttgctgaatgccgatttcttttacttccttcgcatgaaaaagctccaggaacgataccgtttccggaatggaattcgtaatgccgacctggtggttcagcgtccgcagcgtgcgtgagaaccgttcgttgtcctcacgctgatgatgatcgagacggaacggaattcttaccgcttttttcttttgtattaaaatgtcgccttcatgctcattaatgtagcggacaagagttgtaatgttttccgacaagctttcctttgtttccgccgcgacaattgtcgagatgcccagatgctcatgctgtccttctaaatattcgagaatgacatgctcagagatcagctgctgattcgtgatgacaaatacaaaatgcggtttgaactgcagtttttctttgtcatcttcgagatcacgctctctgatcaattcgtaaagtgaagacaagagctgatctcgggtttgctcattataaataaatccttttgcataaatatggggcatttgaaattgcggaagccacttcatccactcccagtctttatactcttcttcatgaaaaataaatacaaaacgcaaatcgtgatagctgttaaagaacgacagctgtccgattagctggtgaatctcatttttcacaatttgcgatttaccgacaagccccatcggaccttctgccaaatcgaccgtcaccggcgcattgcggatatctttatagacgcgctgcatgtgctgcgatttctccatgaggtcatcgatatcacgattcgccaagtctccgccgctcatattgatttcatagcttgacggaactgttcccgtcccaagccgcagctggagataatccttgctttcaagtgatttttcccagatccggtcactgatttcacttgttaagtatttcatttgttcaaatgaaggaaagtgaaattcaagaacctgcttttgcttttcagcaagtgcctgaagctctttccgcttattgtctaagtaaagcttatatacacgctcccgtttttcctcgcgttttttccgctggtttttatcccggaaatattgcactgtcgaggtaatgagagtcatcataaacatcgccaaagaaacgagtataaatatgccgcgcggctggatgatggcaactacgcccatcacgatcagcatcacaagcggaggcaggatgacgagccacagccctctgttggtttgatcgctctcctgagagggaaaactgaaagaaacgcggtcatccggcagatcgtataccatccgcggcgttcttctgtactgcggatattttttctgcatttctgtactcggtttgaccgtttctgttaacgctgtttcaaactgggcataatgaacaatttctaaaaggtcttgttccgtcaccctcatttgcgtgaagttccagaatatctcatcccccggcttgagcggcgtattggcgttgattttctctccgttcaagaagatcgttccgctttcaggtcggaccgaccagctgccgcctgcacgaagcaaagaaaacgtgctttgttctgcaaatgcaaagtcttgcggattcagataaatatctgcattcgttttttctgaggaacatacaatttcatcccggtttcccgtaaaataaacggatttctcaggttcactgcccgtcaatatcaagcgtatatcctgctgatccgtttggagagtaaatgatatatccgcctcaatcgtgccgagacaatcatttcccaggaaaacttcgtattggccgccggattcctttcttttaagagaaatcactccgctattaaatggaatggagctgatcgtaacagaatccttcacatcaggccctatggtcaccggatgagacgacgggaggttagacagatttaatttttgaacgttattttggtaaaaaacccataatagactcaaatggcgaacccccttacggccgaatggcagcatgcgatgacctgcgcttcatgtctcacgttatttgtcatcttttttctcatctttcttttctgtttcttttttctcgtcttcttttttcttctgttcttcttttttcgctttttcctcggctgcggctttttcttctgccgctttctcttctgcttgtttttcttcgtctgtttgtgtctgttcttcgcttgtatcgactaacgatgtttcagaattagactgtttattttcttgacgttctttttgcgctttttcaagctcactatttactgagtcaagttctttttgtatgtcttcatcatttgtatcctcagataaaagctgctgtttatatttagctagggcaaagtaaatataatcattgtattcaagcttacggccgatactgatcgcttctttgtattctcctcgaccataatcaatccaatataagaaatgctgagggtctgattgaagggtgactaaattattttctatatttttggtttttgcactccccaggttttcgacctcaacataggacgtcgccagctgatactgcaccgattcaggcaggctttccgcatcgtacttggacagtgtgctgatgacttcactgtactgcttgtttaagaacgcacggttgctgtccactatcgcttggtgctttggctgcgcgaaaaataaggcgtacatcgaataaataagtgccggtacaagcaaaacaatgagccccaagccgatatatcgctggatgttccacttctttctcgggatatgtatgtatgtttttgctttggcttcgagctcatcaatatgggtttgaatcagctcgagcaaatcatcataggattcagcatctaatatcgcctttgcctctgcggagaacgtcagcgtttcattgaatttcaggtagtcttcaaacgcaaaagcgccgtcaactgccaaagccgctgccgctttcagctcctgccatactctttcctcatcacgctcgtaaggaggaatgctttcttttactccataatggagaaaataaggcgtaagccctttatcgaatacaatgttttcaggagcgacaatcaaattcagcctcgacagattgtgctgctgtacggcttgaacaagctgataggcaaactgccatttactttttttatccttagctttcatgaagcggaatgctttataggaggagggaggttggattgtgatgattacttcatcatccgtcacatcgatttctttatgaaaaaatggatttatatctttgatcacgttagcttcaagaccgtcgagaagctttattttttcccgttgaaaggtaaatgtatagccggcatctgttttctcggcaacagcttctaattggttttctaaatatgatttttgttcacctgacattcaaccagatcctttcataatatttcaagccggtctccgtttgtaatgccgcaatcagacagcttgcattctccggaaaacaccttatccttgttcaccactctgatccagtgcccttcgcgcggaggcatagatacgctttgggcctgccaagcaatatcaattacttttttcaccgggtggtaatctgacaatctgagatcaaagacactgccgttataatgtttcaaatctattgtaatatcaatatacatttaggatcacccttacatagaaagagcgccgtcttcttttgaatcaggcgctccttccctttcatactgttatccgcggatttgatttgcgatgtcttggtcagtagactcaagtgtatttgctgtttgatcaagctgctgattcacatcttgaagcaaatctgacattttgataaatgaaggtttgagctgctcgtattgatctgcgaacgcttcgcttgaagcaccttcccacatgcttttcaaatcagagatcattcggtttaaacgatcaacctgatttaatacttcttggctttcaacgccgtattgcttcgccatcgctcttagctcttcgggtgtgacacgaattaatcctgccatattcctcattacctcctgtgccatcagcctaaatatgggctaattcacttatttttagaacgtcattattataaaaacagtttttcggcatagtcaaacaaatatgttttaattttacaaaatgagtccaatggtttaccccgaatcacttaaaaatgacatatactgtaaagtaaataggtttattttcttaatcttctcttcattctccgaataatccaaaagacccaaataactccccaactcccaaaaaaaacctttcagaaaatttgatgctacagcaccatttctgaaaggttcaattttttctttccttaattagtctcgcctccgatgactttcttagaagattaataggataagctgtcgtattatatgaggcatacaactgtcctgcaaaaaggcgattacaccgccaaatgtatatagaacgtttctctcatgaaattgtttttttgcttctgttctttgttgttgattttcacaaacaacaacaatcataataaaaggaaggggatgagatgtcaaagagaaatcaagcacgaaaagtagggagatttatgaccatgccgaatgatccgtttaaatatagttttgacagacttgaagatgtggctgatcatatcagcgacgttctgcggtgcccgatcaccatagaggatgttaaccacaagctgcttgcctacagtacacacagcgactgcacagaccctgcccggacgtctaccattattggcagaagggtaccggagaaggtgattaacaagctgtggaaagacgggacaattcctgctctcttaaaaacggaccagccgatcagagtcaagcaaatcgatgaagtcgggctgagcaatcgcgtcgctatttcgatttggaaaaacaagcaagtacttggcttcatatgggcgcttgagatccaaaaaacattgtccgatgaagatctgctgacattgcaaatggcagcaaaagcagtgaaaaacaagcttctcaaacttcaaatcagaaaaacgaaaaatgaagaacgcagccaagaatttttctggaaaatgctgaccggacacatccatcaggaggatgatatggcggatgggttccataagcttggaatggccgctccttcagagttttccgttatgatcatccgcataaatggcgagctgactgaaaaaatcgaacagcagctgcaatatttacaggaaacgacccagcaggtttacgtgctgctggcgaccgtagattccaatgaacttattatattaacctcacccaaaacagatcatccttttcaagatttaaaacagtttgctttaagtacgcaaaaacagctgaaggagcggtataaaatagaagacgtttctatcgcttttggcggaatatacaactctatttcttttgtctcccgctcctatcaggaagcattgtccgtcttaaaaacgaaggaacggttcgctgaagagaccaaacattttttcagcttttctgagttaggcatttatcaatacttagatgtcttaaatgaaaaacggaaacaggcgggccattataattactcgctttccaaactggaacaatatgaccgggatcaccagtcaaatatggtagagacgctagagcgctttattgaagcagacagcaacgtgaataccgcttctaagctgttaaatatacacgttaatacgttgaattaccgactcaagcggatcagccagatcgctgaaattgatttgaaaaatgtgaatcaaaaattcaccatctatttagatatcaaacttcggcacatggatttgtgaaatttcacaaatccatgtttttttattttcttaatcaaacaaagaattttccaaaatatcaagctacactaaaaatatcacagatacaggaggagacagatatgatcataggggttcctaaagagataaaaaacaatgaaaaccgtgtcgcattaacacccgggggcgtttctcagctcatttcaaacggtcaccgggtgctggttgaaacaggcgcgggccttggaagcggatttgaaaatgaagcctatgagtcagcaggagcggaaatcattgctgatccgaaacaggtctgggacgccgaaatggtcatgaaggtaaaagaaccgctgccggaagaatatgtttatttccgcaaaggacttgtgctgtttacgtaccttcatttagcagctgagcctgagcttgcacaggccttgaaggataaaggagtaactgccatcgcatatgaaacggtcagtgaaggccgggcattgcctcttctgacaccaatgtctgaggttgcgggcagaatggcggcgcaaatcggcgctcaattcttagaaaagcctaaaggcggaaaaggcattctgcttgccggggtgccgggcgtttctcgcggaaaagtaacgattatcggaggaggcgttgtcgggacaaacgcggcgaaaatggctgtcggcctcggtgcagatgtgacgatcattgacttaaacgcagaccgcttgcgccagcttgatgacatcttcggccatcagattaaaacgttaatttctaatccggtcaatattgctgatgctgtagcggaagcggatctcctcatttgcgcggtattaattccgggtgctaaagctccgactcttgtcactgaggaaatggtaaaacaaatgaaacctggttcagtcattgttgatgtagcgatcgaccaaggcggcatcgtcgaaactgtcgaccatatcacaacacatgatcagccaacatatgaaaaacacggggttgtgcattatgctgtagcgaacatgccaggcgcagtccctcgtacgtcaacaatcgccctgactaacgttactgttccatacgcgctgcaaatcgcgaacaaaggggcagtaaaagcgctcgcagacaatgcggcactgagagcgggtttaaacaccgcaaacggacacgtgacctatgaagctgtagcaagagatctaggctatgagtatgttcctgccgagaaagctttacaggatgaatcatctgtagcgggtgcttaattcacaatgagcttgcagaaagatttctgcaggcttttttattttttaaaaggaaaaaagagaccatttcacgaattatgactatgaagttgatcataaaggaggattcatatggctgttcagcaatatggcgtgttaaaaggcatagtcttagacatgaagcgggaaacagatgatgacagtcctcatttccaagtcaaaatgctcggtgaagagaatacgtattacaggtgcgccatcaatgtgatgtccagttctgaggaatctgaagtattgtatttggctgacgatcagtttgattcgggctcaattaccatccttccgaacatgccgtatggatatacaaggatcaatgaagcaaaccgtgaagtggcactggattatgtgcggggcaatttgtttgacccgcgggaaatgaagcctttgcctcatgaaatcacaggacctgataatgatttaaatgattttattgaaacctatatgaagaaagcacaagatgagaaagcgccggtttatatattcggttcaaaattcggccctgaacaggctgcagataaaatattcggctttaccccgactaacggaatgcacaatatccatatgaatcaagggaatgcaatggatacgcgctggaaaaaagacaacggctcttggcatgacgggggtattctgattcagtttgcagatcagtgggccgctgtgtttttagcgtttttatcccaatcttggtgtaccgatgaaaacggaaacccggtcagagattgtgatcatacccaaacgtctgcgtaagatagaaaaagagactgcggcgagcagtctcttcggaagtttgttgacaaaatcctaaagcgttttaaaagctttaggattttgtcatgttttcagcgtgattgaaaacccttgaactctaggaaagatgagcattggagcggagcgaatgttctaattcgtgagcaccaacgcgcagacttggcaacgaatgcgagggtttatcgacacgctgaagagactgcggctagcagtctctttttgatcagattacacattttcaacagtctttaggctgtttggcctcatatcgctccaatgcgattggatatagtccaaacaagcttcacgccctttttgctcatgaacgactgtccagccgcttggcacatctataaaaccgggccatagggaatattggccttcttcattgatcagcaccaaatatgtgccatccgcattttcaaaaggatttgccattctatttctcctcccttatttattcaactcttccagtttgacagcgagaaccttgccgatttgagccagaggttccggctgacataaatctttatgacggcagtcgatgtcgatttgttcaatctgtctgctaatataaggcttccaagagtcaggttcaatcgggtcaaaccattcaggaatgattgttgatctgaaaaacaaaacatttccatggaaggttttcggcttataggaacctaaaatgccgacagaattgacatacgtattcttcaaatttaaaatgaccgtttcatccaggctcgcaagcgcactgccgtcacggcgaagaatctcaatcgccgcttcaaaatctagcggtttgtcccctaagctgtctggatcgtacccgcctaacgccagaagggcaataagcgcttcctcatcatccggtgcctcttttataggaaggaagtggttcggataggcgtccagcatcaccaacagggatacttcttctccttgattttgcagctgggtagccatcgcttgaacgacattcccgcccagggaccagcccagcagatggtatggaccttttggctggaccgttcggatttgtttaatgtaatcggcagccatgtcatcaagtgttttcggaagctcctcgcgctgcccgattccccgtgcctgcaagccgtagattggataatctgttcctatattggtcatcaaaccggcataacaccagctgagcccccctgccggatgaacacagaataaaggaggcttgtctccacttgttcggagcggcagcagaacgtcaagagcgctttggcttgatcccatttcaagtctttcagcgagcccggctacagtaggtgcttcgaacaagttgccgatgctgagttcaacgccgagcgcttcacgaatgcggctcatgagctgtacagcaagcaaggaatgtccgcctaaatcaaagaaacggtcatcaatgccgacacgcggcaagtgaagcacctccataaagaggtcacagagaatttcttcctgtggcgttctcggtcctcgtcctgtcactgccgctgcgaaatccggagcgggcagtgctttacgatcaagctttccattcggtgtcagcggcaattctttcatcatcacaaaggccgcaggcaccatgtaatccggcagtctctcagcagcatatttgcgcagttccgccgtatcaaatgtttcttccgaagggatgacataagctgccaaccgtttatctcccggctgatcctcacgaacgattactgccgcatcttcaagctgcggatgctgaacaagcgcggcttcaatttctcccaattcaatccggaatccccgaattttcacttgatggtctgcacggccgacatagtcgagagaaccgtcagcgcggaggcgggccacatccccagtgcggtacatccgggtgcctggaggaccgaacggatcagctatgaagcgttcagatgttaaaccaggccggcctagataacctcgtgctaaccccgctcctgatacatacagctctccggcaacacccggcggaaccggctgcaggcgttcatccagcacgtatacaccaagatcgggaatgccgcagccgatcaagctgtttgcccgtaaagctgccatgcttcggtctaattcgatatagctcacatgcaccgtcgtttctgtaataccatacatattgataagctgcggtctattttcagggtggcggttgtaccaatcctctaaacggctgagttcaagcgcttctccgccaaaaatgacatagcgcagactgagtgcctgtccgagatccggctgttcccgttccgcctgcataaactgatagaaagcagacggtgtctggttcagaacggtcacaccctctttgacaagcaggcgcagaaacgcttctggcgatctgctgacgtggtgaggcacgattacaagacgtccgccatgcagcagaggaccccagatctcccacaccgaaaaatcaaacgcataggaatggaacatggtccagatatcatctgagctgaaacggaaccagtgctcggtcgctgcaaataaacgtgttacattttggtgaggaatcatcacaccttttggaacacctgttgagccggatgtataaatgacatacgccgtattcaaaggggaaagcggctgagtcctatccttattttttggattacctgcagggtacgtgtttagtttctctgccagctcgggatcatccagcacgattttcggcacgttttcaactggcggaatgtgatttgcagctttagtgttcgtcatgataaacgcaggctgtgcatcttttagcataaaagcaattcgatcagccggataatccggatcaagagggagataagctgccccggcctttagcaccgccaataggccgacagccatttccaacgatcggggcagtgccaatgccacaaattgctccggcccgacaccttcactaattaggaatcgggcaagccgatttgctctttcattcagctctgcatagctcagtgcctgatcttcatatacaacggcaatagcatcaggacgtaaagcagcctgcttctcaaactgctctggcaaacttgcgtgcggaatcttttcagatacactttgccaatctgtcaccatgctgctgcgttcctctggcgcaagaatatccagatttccgatttgctcgtcaggatcagactcggcagcctccaacagccgcatcaaacggtcagcaagagcctgagcagtttcccgcttgaaaagatcagtgctgtattcaagcagtccttccattccgtttggtgtcccgtcagcaaggcgatcttcactgatttccagcgtcaaatcaaacttggcagaaccgacactgttgattcgcaggctactctccatatcaggaagatgcaattcagcgtccggtgtgttttggaacgcaagcatgatttggaataaaggatgcgtcgcacgcgaacgagccggattgagcacctctacaagtctctcaaacggcagatcctgattgtcataggcggccagattcacttcccgtactctgtctagaagctcacgaaagcttgggtcaccggacgtatcagttctgagcaccaatgtattaatgaacagccctacaagatcgcccagcgcatcatcattccgtccagcgatcggactgccgatcggaatgtcggtgcccgccccgagccttgtcaataaagcggcgagaccggattgaagcaccataaacaggctcaccctatttgcgcgagccagctcctgcaatcgcttatgaagctcgggctcaatacgaaaatgaatcgtatctccatcatgactcggctcagccggacgtgaataatcggttggcagctcaagctgatcaggcaggtttttcaaggtttctttccagaaagcaagctgtccggcaatcaagctatttggatcatcctcgtttccaagcagttcttgctgccaaagcgcatagtctgcatactgcacagcaagaggcgcccattctggagatcgtccgtggcagcgagccgcataagccgtcccaaggtctcgggtcagcggtgttaaggaccagccgtccccgacaatatgatggacgagaagaagcagcacgtactcgtcaggaccgatcacaaaaagctcggcacgaaaagcaggttcagctgcaagatcaaagctgtagcgtacagcttcggcaagccgatcagaaagctccttctcagcaatttcagtaacatgtaactcgggacaggcttgatcagcatctaaaatatgctgataggatgtcccctgtgattcagggaagattgtccgaaggctttcatgacggcagacgaggtcataaagtgccgctttcagcaatccttgatccaactcacctgacaaacggacagcaaccggaatattataagtaggactcggtccttccagacaatgcaggaaccatagccggcgctgggcaaatgagagcgggatcttttcaggccgctcagctctctgcaaagcgggacgtgcactctgcgccaaatcaagatgggcagcgagtccggctactgtcggttcgtcaaagagcttggcgataccaagttcggctcccattacctcgcgaatgcggctcatcagacgggctgcaagaagagaatggcccccaagctcgaagaaactgtcatcgataccgacgcgtgccaaaccgagaacctctgcaaacaagtcacacaatatctcttcctgaggagtccgcggggcccgatcactgacagatgtgctgaagtctggtgccggcagtgctttccggtcaagcttgccattaggtgttaacggcagctcgtccatctccacaaacgccgccggtaccatataatcaggaagactggcccccatataacgacgaagctctgcagtatcaatagcagtatcagcgactacataagccgccaatcgtttgtctcccggctgatcttcccgtacgacaaccgcggcctgttcaatgtgcgggtgattggcaagcacggcatcaatttctccaagttcaattcggaatccgcgaattttgatttgatgatccgcccgcccgatataatccaaagacccatcggcgcgccagcgggcctggtctccggtccgatacatccgagttcccggcggtccgtatggatctgcaacgaagcgctccgccgttaaatcagggcgatggaaataacctctggccaagccggttcctgcaatataaagctctccgacaacgcccggcggcaccggctgcaatccattatcaagcacatacacctgcgtgttccaaatcggtttcccaatcggaggaacgccctgcaacccttcttcaagaaaagctgcggcagaccaaatcgttgtttcagtgggaccgtataagttcgtgactgaacaatgaaggtcttgaagcgcctgcaaaagaccgctcggcagcgcctcgcctcctacaagcactctaagcccccgaagtttctcaggttcactcgttaccaaagcgtgccacagtgtcggtgtcgcctgcatgatgttaatatcgaaattttcaatcatttgagctaatgcctgcggctcacggatcgtttcttttcttgcgatcacaattcgcgctccgctaatcagcggaagatataactccaatgctgaaatatcaaaagcgacagtcgtcacagccaacagcctgtcttcttctcctagagaaaacgcctccttcatggacagcagaaaattgtttaagcttttctgtgtcacaacgactcccttcggtcttcctgttgatcctgaggtatagatgatatacgcaggatggtcaagagaaaccgatacatccggattttccggcgaatagcgttttataatctcctgtgtaacagcctgatcaagcacaagctccggtacagccaggttatcaggcagactggctgctatttcctcagtcgttatgatgcatgaaggtttcgcatcctccagcatgtaagaaatgcggtcggctggaaactccggatcaagtgggagatacgccgcaccagtcttgagcacaccaagcattgagaccaccatctcaggggaacgcggcagcgccaaagcgacaaattgctccggaccaatccctttttcgatcaacagacgcgcgaggcggtttgcctcttcattgagctttcgatagttgacttgaatgtcatcacacatgagagcgatacgttctggcgtaagaactgcctgcttttcgaacatgtcctgaaggctgaccagcttctcggattttgccgtctcattccatttagaaatgactttttctttctcctctggcaacagaagctccatttgcccaatcagcatgtcctctccggcagaagccgtttgcagcagctgcaaaatacgctgctgatgaagcttaatatcagactcactgtatacctcgggattcgcatcaacatcaattcgcagcccgctgccgtctgttctgtcatatacattgattgatagatcatcaacaggaccggctgaaagattatgcgttgtgccccggacgccggcaaagtcgagaccgtaatcaaacggcataagattgatttgagggccaaataatctatgattttctcctatcaatttcagatcgcgccgaagctcttcatggcgatacttatgatgtcgccgaatactgcggatttcccgggaaatttgctgaatcagttcagaaaagctcatcgaagagcttaccgtcagccggagcgggagaaggttcatcaccatagccggtacattcagtgacgcggaccctatccgacccatcatgggcaggccgagcacaacatcctcagagccggtcatacggtgcacataaacagctgacaccgcaatcatgacttcatgccagcttcctgagaaatagcgcgccgcttcttttaacgcgtttacatcagacggaggcagatatgccgtatgacgaagaaaactgttagatgttcttggcgcccgatcagccaagctcacaacttcaggtgcatctgcaaaacggtccagccagaattgacgatccttctcatactgctctgatccgcgataatctgtatcctcctccaaaatggcctggagagacccaaaggaacggcctttagctgtttgtccttttataagcgcagtatatgtacttgccacacgctgggctatcagggaaaaaccgaagccgtcgatcgctatatggtgaatgcgctgataccaaaagaaacgatcaggcccggcaataaacagagcttcattgaacaaagggtcataccctaaatcaaccggctttgctaaatcagctttcatccagtttaatgctgttttttccggatcaggctcagagctgacgtcaatgacgtgcagctgtacatccggagacgggtttatcatctgccaaggcccgtccatattttcaccgaagcggacatgcagcgattccgcttccttgatcacgtgccgcaaagcttcttcaaaaagagcaatattgactggtccattgatttctatatattccgctgtattgtagattggattgtccggatcaagctgctgagcaaaccatatgccagtttgcgccccggtcaaagaatattgaagatcttttgtatcaggcatccgtttgtttaccctccttttataaataatccgcgtttggcagcacttgctggctgcgggttgtgagcaatttttgccattcttcgatcgttgggcgttcagccaattccacgaaagtcacctctgccccttcacggcgccattgttccaccaatgtcatgatccttaccgaatcaagaccacgatcgagcaaatcctcttgatctgtgatgtcttccggtgtttcttgtagaagctcagcaatttgtttacggatattctcacatgtaaacacgttctttttgccagtgtttgctgacgttttttgaacgtctgccggcgcattctgcagctgatcaagaagactgtcagtcatcacggtaaacgcacagcgtccagccgcatagtccagcgccatttgatgtttttctaatgaaaaatcagcaactgcatctcccacaaaaaaggctttaatatcctccataaatgcttcacatgctgtaacaagacagccgatatgggcataaattcctgtaatgatcagctgatcgcgtccctctttgcgcatcatttcaagcagattcgttctcttaaacgcgctgtatctccattttgtcagcacaagatcatcatcctctggtgccagctcggttataattttctcctcataaggaccgctgtttaatcccgggccccaaaagtctgtcagcagcgcacggtcatccggattttggcttcccggctgtgcggtatagacaacaggaatcccaagctgaacacattgattcttcagctttcgtatattcgctgaaagctctattaccggagacgctcccgctgtgaaagcatcgacaaaatagttttgcatatcgtgtattaacaagacagcccgattcggatcaggcacccatgatactttgttttgcggcatatcagatgctgtcggcatttgatacggctgaatggcaggtatagccatatgaacacttcctctcaaattgttgttttatttttttaatcctgcaagaagcttctcggaaatggcttcacggagcgcttttttgctgacttttcctacccctgtctgcggaaaggattcgacaaattcaactcgatcagggattttatatgccgccagtccgcgctctctcaaaaatgctttgagctctgcggcttttggggcttcatcccggggaataatgaacacacaagatctttcgccaagaaattgatcaggcatggagaccattgccgcatcatggacagccggatgcgccagcagatgattttccacctcttcagccgcaaccttttctcctccacggttaatttgatccttcgcccggccttcaacgacaatatacccgtctcgtgtcagcctgacgatatcacccgtacggtaaaaaccgtcctcagtaaatgaagcggcgttatgctcttctgccttatagtaacctcgaattgtatacggtccccgcgtcagcaaatggcctgtttcaccaggttttacgtcgcgatcatgatcatcccaaacacgcacttcatcatatggggacatcggttttccttgggtgttgacaatgatctcctcaggatcatccaatctcgtataattgacgagaccctctgccattccgaacacctgctgcagcgtgcagccgaaaacagcttttaccctgcgcgcggcttcagcactaaacttggcaccgccgacctgcaacacttgaaggctggataaatcgtcacggcgtgaggatgccgcatccatccataccatcgcaagaggcggaacaagagcggttatcgtgaccttttcccgttcaattaaaggaaatgcgtcatctggacttggagaaggagataataccactcttcctccagcgtataatacgccgagaacgccaggtgagctcagcggataattgtgtgccatcggcagcgcggccaagtacaccgtgctgtggtcgagccagcagacctccacactccgcttcaggctgtatatgtagtcatcgtgggtcctcggaatcagtttcgatagcccggtgctcccgccagaaagctggaggaacgccacatctgaagatttgacttcaggcagttttacaggttctgtatgcaaatcctccagcggcaaaaattcctctgcctcacctgcgacaatgatgtttttcaaagtcggcagcttgctttgaacctgtctggcaagcgaacggtagtcaaaaccggaatatgcgtcgggaatgatatatgcagccgcttcagcaaactcgcaaaaatatgtaatttcactgcttcgatgagaaggcagtgcgaagactggaagcgcccccagacggaatagcgcgaaaataacttcaaaaaactctttgatatttggcagctgcaccacaacacgatccttctgttgaatgccgagcttctgaaatccggcagccaggcgatcagcccttgtgtccagctctcgatagctccaatgggtgtttccgcatgtaatggcaatgcgatcaccatatttggctgcccggtcccttaacaaatctccaaacgtctcaccggcccagcagccgttctttcgataggtctcagctaactcatcaggccaaggcgtaaatcctttcagcatgttgtatccctccagcaattcattctgttcatatgtgatccacgcccattgcccgcagcattgtccgaaactttgcggacgtctcctgaagctcgtcctcgggctttgaaccggccacaacaccagctccagcatacaggcggagtgagcgttcttctgcttctgcacaacggatggtcacgatccattctccgtcaccggcatcgtcacaccatccgaccatgccggtaaagaaaccgcggtcaaatggttcaatgctgagaatcgcttctcttgcaagatcagtcggtgttccgcagactgctggcgtcgggtggagagccgctgccaattcaagtgcggttacagacgggtcggaaagctctcccttaatcacgctggacaggtgccacatcgtttccgttttgatcagtgaaggcttctccggaacctccagcgtccggcagaaaggtctcagcgctgccgcaaccgcgtcagcgacaaccgcgtgctcatgaagatcctttgcggaagaaagcaattcagctgcccggcgctggtcttcaacaggatcattactgcgcggccttgagccggctaatgggttggaaacgacctgtgttcccatccttgaaacgagaagctccggacttgctccgagcaatgttcggcggggagacgtttcctcctgactggacacgtctgcggcaaacgtgtagccatgcgagttatgctgagccagatggcgaagcaattcatccgtctgaatcggttcaggcgatgtcaaatgcagcgacctggacagaacgattttgctgagtgttccatcggcaatgcgtgccagcccttgttcaacaccatttttataatcctcaggttcaggaacaggctttatgtgatatgtatgcccagcctgctgttccttttcctcatgatcaaattgaagcggtcctgaccagcgcacttcttcaggtacaacgagccgcgctgcttttacttgatcaaaaggaacggccccgacaacaagcggccggctttgccctgattgttttgcctgacgtaacgcctctgcaattcggccagaaagggtttccatttggttttgcccgtctgcctccggtacgatttcacatatgcctttcgctaacagtacacgatgaggagacgctaagaaaaaggcgcccggctgatattcatgaagcaaatgctccgcttttgtttctgttataacgttttgatccaacattctcatgaacctcctttaaattcagttacacgcctaaggtcgcgccgccatctacgcataaattatgcatcgtaatatgccctgcctggccagaaaccaaaaagagcaccgcatccgcaatatccgaaggcttggctagttttttgagcgggatccctgttttaaatgtctcaagtgatccttttatgacttgctccgctccattctcgtcggcccataatgaccactgcatgtctgtttccgttgatccgggagatacaatgttgcagcgaatattgtattctgcaagctcaaggccaaggcatttcgtaaacatcacagccgcagcctttgaggacgcatatgccgccatagatgttcttggtacaccggcagcattcgatccgactgttacaatcgaacccgatcttcggtccatcatatatttgctgactgaacgcgaggcgttaaatacgccagtcgaattcactgagaacgtcgcctcccattcctcatcgctaagcgaatggatcagtcccgggcgaaggacacccgctacattcactaaaatatcaatcggccccatttcacgttcgatgcgcgccgtgatctcatcaatcgccgcgctgtctctcacatccgcaggaaaagcttctgcatggcggccttctgctttgaggctgctcacaaccttttccagcttttcaggattataatcaaccgccgcaatatgtgcgccttgactagcaagcgtccgcgcaacagcttcgcctattccttgggcagcccctgttataaaagcaatttttccctctatactctttgcattcatatcatcaattcctttcttcgctctaaatgccgaacagacatccagcgaaaaagactgctgcgccttgaaaaacgcaatctattgataatgattatcattatcaattataaaaataatcatatccaaatgtcatgtgacagtcaaatataatttcagtgacaaatatttttttaaaggcaaggctgagtatgtctcagcccattgatagatgcggtccgtcagggtgaagcgcaaaacgcagcgccctgctgaccaaaacaggaagaactgaaatatgtccttctcctgaaaactcgcaaaattctgcccgtatgccttgttcagataaaacggccagccgctcataaagctcccttgcattatcattcatccggcttttatgatgctgctctaattctcctgcggcaagcaggatattgataggctgattgtttttcttggtgagagagacgaaatggtccgttttctcgagaataaacggtttattccaatgaatggacggacttcctgcgatatacgtttgaaacgcatcgggctttgttagcagcacctgcagcacgaaaagccctccgagcgaatggccaaagattgtttgtctttttttatcaatctggtaatctcgttctatctccggttttaaatcctcttcaataaatctgaaaaagccctccgctccgccatgctccggccattctctgccgtcgggcctttccggcagcttcgattgggctgttggcattgtaaaatcccggtggcgtgctgaagagaacggctccgctgtctcatagccaatgccgacgatcactgcagggatcaccccggttttttcgggtcggcgtccctgtattcgaacggcttccgtcatcgttccgaagacagaattggcatccagcagataaatcacaggataaccagtgggtggcggcggcgtactaggtttcgagataaaaatgtgataggtacggttttcattgcgtgaagacatcatacgcacttccgtaccaggaatcgtaaatgcgtttgatgtcccgctatttgtccggtctgttgtttgctctttcatgcagtacgacattcctctccttaaactaaaccgcaatgtatgataatgattttcactatcaactagacacctcaaataataggttttcttccaaagaaagtcaactttttcccgaataaaaaaggcaccttgatcaaataaggtacctgcagactatcaatatggaagtaaaaacctaataaagatgcggattgtcctatttgaaatagaaccttaatcccatgtaaacctttgattttgccaagggtcgcctctcatgtgatagccattccgctcccaaaagccagggtgattttctttcgtaaattggatgccgcgcagccacttggcgcttttccaaaaatatagatgcggaaatacaccccgcagcggaaagccgtgttcaggggttaaaggttcgtcattatgcgcataagccagaagggaagtttccgctaagaaatcatcaagcggcagattggtcgtccagccctcttcagcatgtaaaataacgtagcccgcttcttcttttacacccgctttttccgctatatcacaagcccgcaccccttgccacacattatcaagccttgaccatcccgtgacacaatgaatgtcgttttttgattcataccgtggaaaggctttgacatcttcaaagcttagcagcatcggatggtcaaccaaaccgtatacttgaagattccatttcgtcatatcttcgtaatatgggacatctccggtatgaagcacaggaaatgaagtggtgacgttttgatttggcggcactcttccagattgatcggactgtcttgtttttccgaaatacatatgggcctcctttttgttaacctattttaaaatcatgttgacaatctttttgttctttattactctatgattgtgtatgtcaacctaagggggaacaacgatgaaacaacgtaaacttcgtgcgggagatatggcgctgattggcatgttcgccgcacttatggctgtcggggccaacattacatcagtagcaccctttttacaagtagccggcattccgctttcgatgcagccgtttttctgtctcttggcagctttgcttcttggcagcaaacgagcagcgattgccatgattgtatatgcacttgtgggattggccggagcgcctgtgtttgctcaattttcagcaggcttcgcaccgtttgcagggaaaagcggcgggtttattatctcatacattccggcagcatttgtagcgggatggtttttagaacgaaacattcagccaagtaaaattcgatttctcattgcttcacttatcggaacggcgatcatgtatctcatcggcactacctatatgtatcttgcactgaagctgtggattcatacgccagtgagctacggcacggcttggggctttatgatttggtttatggtaaaagatacagcgctggctgtgatactgtcgtttatcgcaccagcaatctaccgctctattcataaagcaaccggctttaacagaaatcacatatcatctacgtaaaaaccgttctattggacggttttttatcataacgagaaaaggctccccagtaaaggggagcctttttcctataaaacaagcgctgcaatccagccaaagatgacaagcggaatattataaaatataaatgtcggcacacaagtatcccaaatgtggtgatgctggccgtccgcactcaaacctgaagtcggcccaagcgtactgtcactggcaggtgaaccggcatcgccaagcgcagcagcagccccgataatcgcaatcgttgccatcgggctgaatccaagctgcatgcatagaggcacgaaaatggttgtgataacaggaatggtcgcaaaagaagatccgatccccattgtaattaataagccgacaatgagcatcagcaatgcgcccaaggactgactgtgtccgataaaaccagctgacgttttgaccagtgactcgacatctccggttttcgtcaatacgtttgaaaatccggctgcaacaagcatgacaaagccgataaaggccattaaaaccattccatcagtaatcagtgagtccgcttcatcacgcttcatcacaccgctgacaaacagaacaatcagaccagcgagcgcccccataatcattccttctactcccaaagtctgagataagtaaagctggacgccgagtgacacaacaatggctagaaccgcgataccaatgctttttctcgtatatggcgatgcttctgcacctgaaatgtcttttgtttcatattgtttcggtttacggtatacgatcactgataaaataaggccgacaaccatacctgcaactggaataatcagtgcgtacggaatatcagcaagcggaacgtttaacccggcatccgccatattgtccttcagcatgccttggaagatttggccgaaacccaccggaagcaaaatataaggagccgttaagccaaatgtaattacacacgcgatcagacggcggtccatttcaagttcattaaagattttcaaaagcggcggaatcagcaccgggataaacgcgatgtgaaccggaacgacgttttgcgaaaaacaagatacaattaaaataatcagcacaatcagcaccttagaaagtgctttttttcgagaatcttccttatttccgattaatttaacggaggcttccaccattgcgtccggaagacctgttttcgtcaaagcggcggcaaacgcgccaagcatggcatagctgactgcaacggtggcatttccgccgagaccgtctgtaaaagctttaaccgtttcgccaagaccgagcccgcctgttaacccgccggccaaggcgcctataattaatgcgataacaatattgacacgcagcaggcttaatacaagcataagcaggactgcgatgacgactgcattcatgatgatacccctccaaaaatcctttagtttgctaatgtagtagataaataaagtacgaacgtatcgtatcataaccgatccactttagtcaactaaagatttcggaagaaaaaatccctgccgcatcatacagcagggatttttcattactcgtttttatcttcttccaatgtaaatcgctccgcaagtgtagccagtgttcttgccataacgccagtagccccggccggcccgaagcaggttgctttattggcagtcgctgttcctgcaatatcaaggtgaacccaaggtgttgactcagcgaattcaccaagaaacgttcctgccataatcgcatgtccctcgcgtcccggtgaattgttgagatccgccatttggctgcttttcacgcgttttttatccttctctgttatcggcagctgccagattgcctcgccgcactcttgtgcagcatcagctacctgctggtaaaagctttgatcatttgtcattgcaccggttgtttcagttcctaatgccacaacgacgccgccggtaagcgtagctacatcgacaagaactgacgcgccatgctgtttcgcgtatgtaatgccatctgcaagcactagccttccttcagcatccgtattaaggatttctattgtttttccgcttaaagatacgatcacgtcatccggcttcatggccccgccggagatcatattatcggttgatggaataacgcacagcacgttttgctcaggacgaagctctccgatcgtttccatagcaccgagaaccgcagctgctcctcccatatctgatttcatgccgacaattccagatttcgttttaatggagtagccgcctgtgtcaaaggtaattcctttcccgactagtccgacgacgtcctcccattcctttttgccctgatatttcaacacaatcattttcggcggttcggtggagccttggtttaccgcaagtattccgcccataccgagctcttccatctctgatttctccaatatctcacactcaaaatcatatttcgccgcaagctcttcagcatacgaagcgaggtcagtcgctgtcagcatgtttcccggcatattcacaagcgttctagccgaatttgtcccttgtccgtatgcctggccgacgcgaagcccggcctgcacttcctgtgtatcttcatctgttacaacatacacggcttcaatttgtttgtcaggctcatttgatttgtgcttataatcctgcacctcataggaagcaagcaggcagctctcagctaaagcatgagcggcatcggctggaggcacgtcttccgaaataaacgtatcaagcaggacagcagtttcttgttttcgatctttatgaatggcttgaaaaacatgagcaaaacgttccttcgcctgttcaaacgaataattagcttctctccccagaccaacgaaataaatccgtttcatacccgcagaagatggagggaatacttttgatacttgattcggtttcgcagagacatcaccctcttttaaaagctgtgtcagatggccttcgagcatttcatcaatttccaacgcttttcctgtcagctggcttttttgaaaaagcccgaccacaagggtttctgtatgctctgattgttgaaccgcataaaacatgaggcttacactcctaacgtaatgggtatttgtaatgaacaatggtataataggaaaaacattctttccactatacttattttaacaaacaacagtctaagacttgcttttttcttttgaaacacgaaggatttttcaaatagaaaggatgtcgccgatggaacttttaacgaattttcctttattatcaagcctggccgcaattatttttgctcaggtcatcaaagtgcccatacagtttatcgtgtccagaaaactggactggtcgctggtcacaagcacaggcggcatgccgagctctcactccgcagcggtcactgcgctttctacaggcgtagccttggagcatggattagactcctcactctttgcggtttccgccattttcgccgtcataaccatgtttgacgcaactggcgtcagacgccacgccggtgagcaggcaacagtcattaataagcttgttattgattttaaccgtttcgtaaatgaagcgaaggacttccctaaggctgcagagaaagaaaagcaaaaaaagctgaaagagcttctcggacatcagccgatcgaagtctttttcggaggcctaacaggtattttactgacattggtactcgcttactttttcatgtaaaaaaacgctcctgctttcgctggagcgttttattctttcacagttttatattgatttctgaacacttgcaaagattttgtttcattgagcttctcaagctcatcctcggtaatctttcccattccctttttaatcacatatacatcaagggtttttttgccccattcattgtatacatctttgactgtctcaaagtacagatcaaggcggtttcccttaatagctgatcctgtgtcggccacaactccgagaccgtagttcggaatgaataaaattgttccgatcgggaaaacggacgggtcagcagcaaccgtggaatataaatcccgtttcactttcacacctgaatatgtaagcccgtataatggatcaccgggatttttgcccgtcgactcagctcctgctgtgtagcctgttgctgttactctttggactggatattcatcccaatcaaatgcctcttctaacggttttgttttatcctcagccgcggacgtggtttgtgtttgtttctgctgcaatgcttttaatgtcagtcctgcatgcttcaagtgcttttcctgatgttcctgcacccattttgacaagtccttcgcttcaattcctgacactgataaaaatgtcgtgccaaatgcaagcagaaataaacaggtcatcagcaaacgtctgatcatattcaacatcattcacctctcctccgaatcattgttcccaagtggagagagcattattcaaaatggtgaatgagctgaacgcataaaaaaagctttctttagaagaaagcggcatttaaaacatttgatatcctctttttctgagcatgttgatcgctataccggacacgatggcgccggccaaaccgctggctaaaatcagcacatcggcagccgctaatgataagacacgatgaaacagactggcaaaggattctcccggcgactggacatagctgatcagcttttctttgctgataatgaaaaggcatacaatcggataaatcacagccataatccaagacattctcagcagcatgtttaataagaaaccgattccaaaaaacaagacaaaaaacaaaacaattgagatgattacgactggcagactaatcaacctattccaccccctgcgttgtttttagtgtaacgcgggggctgaaataaagtcaacggctggaaaaagaatgactgtcttttcctgtcccctggcaagacggacaagtctctgaaccgccgagaatcaattgaaaatatcctttccctgaacaaaatgggcatgcatgtgaagcggttgtcgttgcagttttcatctaatcatcacccttttttctcaattttctgataatataccatatcaagctgtcaacaataaagtcagatcatgtgacaaatcttttgatgtaagcggaaacatacttgttttcctctcgttctctttttattttggcgttttttaataaagaaaacccgcttccgcgggtttttagaaaaacttgaacttgccttttttcaatgtcagtccgagtccgccaatcataaacagcgagcggttatcaatgacttttttcataaacgaagcgggcgtgcctttcagctttctgccataaacaaccccaaccgcgttatgctcgccaagagaagccactgttcccttaatgtccggcttgaattcctcaagctctccgcctttaataagcctgccaaggtttttagcgaccgttatgccctgctgcattgcaatttgcgcagtaggcggatacggacgctctgtatcttcattcataaacagcgagctgtcgccgagaataaagacattgtcatgtcccggggcgcgaagatcagggttgactttcacccggccgcgcatattttcaaaaccggcttcctccacaatcggatggccgcggacacctgccgcccaaacaacggtttgcgatttgatctgctctggttcctcatcttttttgccgactctgactccttccggggtacattcttgtacagccgtgccgatcttgaactcaactccgttttcctcaagataatgtacggcgtaatcaacaagttccggatcaaagcccggcaaaacggtcggcgctgcttccacacaaatgatgcggacaaggcttctgtcaacgtcatattccttacagagctccggcacgcgagcagccagttcgccaagaaattcaattcccgtaaatccggcaccgccaacaacgatcgttaacctgtccggccgtttttccgcttccgtattgtaagtcgcaaactgcagctcaatatgttcccgcagcaggcgcgacgtgttgatgttggcaatcggaaacgcatattcttttaagcctttaatgccgaacgtttcaggcacggcgccgagcccgatgactaaataatcgtactgcagttctccattcgcaagcacaacttttttctcatcaattttgattgcctttacggtatcctgtacaaaattcacccgtgactggttgattacatcttttatctgataacggcagcggtcatgatggagcgtacccgcgctcgcttcatgcatccatgtcgtttcataatgataattgtgtttatttacaagcgtaatgtcagcatcattcggcccgacatacttcgtcagccttgtcaccgtcatcaatccgccatatcctgcacctaaaatcacgattttgggcttattcaatgccatcacatccaccttctctttttttgcttttgttagacccataataaaatcatcatttgtgttagcttcagcttattggcgggattttatgaaatatattgaaaagttttttgtgaagtccttacccgtagcactattatcatgtttatccggctggcccaagaaacattcagaaaaagatcatttcatttggttattatcgtagcggcctgcggaaatattttcaagaacggatgggcacgttagatccttacgattttttctgctgactcgtcaatttgaacggcaatatggtataattaataacaattttcatttaggaggcaattttcgtatgcgagaggatacaaaggtttatgatattacaattataggcgggggaccggtcggcttattcaccgctttttacggcgggatgagacaggcaagcgtcaaaattatcgaaagcctgcctcagctcggcggacagcttagcgccctataccctgagaagtatatatatgatgtagcgggattcccgaaaatccgtgcgcaagagcttatcaataacttaaaagagcaaatggcgaaattcgaccaaaccatttgtctggagcaagcggttgaatctgttgagaaacaagcggacggcgtgtttaagcttgtaacaaatgaagaaacccactactctaaaacggtcatcatcactgcaggaaacggcgcattcaaaccgagaaagctggaacttgaaaatgccgagcagtatgaaggcaaaaacctccattacttcgttgatgatctgcaaaaattcgccggcagacgcgttgcgatccttggcggtggagattccgcggttgattgggcgcttatgcttgagccaatcgcaaaagaagtatcgatcatacaccgccgcgacaagttccgtgcgcacgagcacagtgtggaaaaccttcatgcgtcgaaggttaatgtcctgacaccattcgtccctgcggagctgatcggcgaagacaaaatcgaacagctagtgcttgaagaagtgaaaggcgaccgcaaagagattttagaaattgatgacttaatcgtcaactacggtttcgtttcatctcttggaccgatcaaaaactggggcctggacatcgagaaaaattccattgtcgtgaaatcaacaatggaaacaaatatcgaaggcttctttgcagcaggtgacatttgtacatacgaaggaaaagtcaacctgattgccagcggcttcggtgaggcaccgacagcagtgaacaacgccaaggcttacatggacccgaaagcccgcgtacagcctcttcattcaacaagtctttttgaaaataaataaaaaaaaggagcttgtgtctgcgacacagctccttttttatttgaagatatttatataattcaatgcagttcctacaaccagcgcaatcacaagggctgcgactacccagatcattgccataataatgcggtcctgaatcttttgggacttcggtgttttttcttcgttttgggccatcttattcgctcctttcctatgtccatgccataaagaaagcctggtgctgaacgaccaagctttgctgaacgtatatcattcgcgttttgatccgctctctaagaccattcgttaaaactatgatacctaaactcaccctgcatgacaagcttcggcacttgcaccacacctgccagcaaatcataatgtttgacatcctaaataaaacagagtacattatagaaggcgaacatttcatatattatacttttaaatattcgtttttaggagtgaaaaccatggaaaacgtatttgattacgaagatattcagctaattcctgcaaaatgcattgtgaatagccgttcagaatgtgatacatccgtacgtttaggcggacgtacatttaaattgcccgtcgtccctgccaatatgcagacgattatagatgagaagctagcgattcaattagccgaaaatggctacttttatgtcatgcaccgatttgagcctgagacacgaattgattttattaaagatatgaacgcacgcgggttattctcttctatcagcgtgggcgtcaaagatgaggagtatgaatttgtccgccagctggcagaagaaaatctgactcctgaatacgtgacaattgacattgctcacgggcactcaaatgctgtcattgaaatgatccagcaccttaaaaaacatttgccggacagctttgttattgctggcaatgtcggaacgccggaagcggtcagagagcttgaaaatgcgggagcggatgccactaaagtcggcatcggaccgggaaaagtatgtattacgaaaatcaaaaccggcttcggcacaggcggctggcaattagcggcgctgcgctggtgtgccaaggctgccagcaaaccgattatcgcggatggcggcatccgcacccatggcgacatcgcaaaatcaatccgattcggcgcaacgatggtcatgatcggttcactatttgccggacacgaagagtcgccaggccaaacgatcgaaaaagacggaaagctttacaaggagtacttcggctcagcctctgaattccaaaaaggcgaaaagaaaaatgtcgaaggcaaaaaaatgcacgtggcgcataaaggctcaatcaaggatacactgattgaaatggagcaggatcttcaatcttctatttcttatgcaggcggaacaaaacttgacgccatccgcaacgtggattatgtgattgtgaagaattccatttttaatggggataagtactaatatgcgaaaagcacccggatttgggtgctttttatgtgtaaaaaaatgttatatggtatattttagtaataaaaaatccttgtttctacattctttcttatcgtatcttagcgtcccccaaaagcttgtccaattaaacttgaaacatcctcctcggccagttcgatttctagtcggtgttaataaatacatgacatcaaattttgaaataagtaactccatttttataatttttccagtagtttcgtaaaacccacctagactccatacctcctattaagaaaaagttatttcattttccaaattatacatttataaacttgtcttcttttccactcgattctttagccatctatatacatttgctatattaatttcaaaaccttttccctctaattttgttagagccactgctcctccaaatacctcttccttatcttcctcttctgatagagcttttgttaccagagaagcttgaagtattgttgaatcaattatcctttgttgttgctcaaccaaagtttgaagttgttcaattgtttgagtttgcaactgcactgttgcatttaaaaatattatctgactcttaaaatgctggacgttagccattaattgctgaatttgaaggtcacttgagaagttcgtatatccaatatcatttaccattgatggtagctgcaaataaatttctaatgcttcttgtataatgtttaaagcttcatctgttgattctggaattactgtaaaaagtacattatttgcttgatgcgtaatttctgtagttgctttaatacctatattctttaagaattccgaaaaataaataagatattgttcacatgcaacacgaacatgttcagggaattcaaagatactagttagagtaccttccctattttttaaaatcaactgatttattgcttctcttgttacattgttagcgatacgtaaatattcttctaaacaattattagaattattattacaaataaactttaaggaataaccatatatatcagattcaatggtaatatccatccgttttgcgacatcattagcttcatatattaattcttctgtactaaaaatatttttccatttttcagtttcccaagaaaaatcaattaatatttcaaacattttatcatcaggtgaaaaaataaaaaatatactttgtttcaaaccagtaatatccaattcagttgggatttctattgttactgattttttatattcatttgcaagttggatcttattaaatggcatactggttatacttgaaacaacttcatttgcaatgacttcaaaaataatctcaattttataagtgaagagtttcaccttttctggttccatgatttgtttattaatttctaaaaaaggctcacccttataatctttaattataatcattatcttctcctcctttcagacttactttcatcgctcctttagcgctctatatatagtcgtttgcttatattatttaaactgtattaagcttattctcccttttattcctactaccgaataagtctaagggcatgttgattttcttttagtatatttcccctgtctttatttgtaaactcctctcttcttaacttcttcaattcatttgggtgcatcatatttaagataattggcataatcctaaaaattcaggagaataagtcgtttacatttcaatctcgtagtgtttgtgaagccaagtaacaaggagctccaattttactctcttaaggtttcctgtctcaagccttttgcatttttacctgccataactacgccaatttcttattccatagttgatttgtaatattaatttttggctgttttcttcctaactcttatttaataagaaaacttctagatatttatgtgattgacattaaatccagaaggattgtaattcacaattcttattatattttgcgcactaaacctcagaattcctcaggcccacctacatttgttgctttcttgaacaaagaatcgcagacgcagacgaccagtttacgatagatgaaaatacgaccatagcaaggtttatatacgatatgcacaagtattggtgttcgctatcctgccgccgaagtattcccctaactttacctaggttacatacactttaaagtacaattttcacaatatgaaatctctatcccgctctttaattctttctaaaaagaaatacttatatatttttcaatgcttttccattattcttgccatttgttttgcatttggattttcttcattttgcaactgttcaatgatgttcatataatccgtttcatttcggttctggcttaatttatatgccgcttgaatgtcttccaccttaatcttaaatccaacgatacctttcaattcacgttctaagagttttggagaaagcttatcccataaaacaggattgtcacgatgtttttcgtatttctccagcatgattgttaattcttctgctaattcatctttctctaacatacttgcttttccatacatgtggacagcctgataattccacgtcggaacattttcgcgcgaataccaggaagaagaaatataagcgtgcggtccctgaaacatcacaagcacatcttcacaggcttcaaacgttctccactgaggatttccataagcgaaatgccccgtaatatagtaatgatcatcttttttattgaatcctaacggcaaatgtgtggcaattggttttccttgttctgttgtgacaaccgtaccaaaggagttttcttgtacaaaattccaaatttcttcagcatttgtgactttaaaatattttggaatatacatcatcatccacccttcgaaaaatattatatgagtgttttagccatgattaaatccgtttgttcttcatcacccatataaaaagagtgggcgccggtctgaacaaaccccattttcttataaaaggcaatagcattttcatttttttcccacacacctagccaaatgttctttttattacgttccagcgcaatttctatcgctttattcagcagatgtttgccaagcccatttttttgaaagctgttctttatataaattctctcgatttcaagtgattcagcacccatttcttcagactgagcatcatcgatattgacctttacatatccagcgatttcatgatcaaagtaaataaaaaagaattgcgaagacatattggataactctttttccagctgctcagtgttaaatgcactttctaaataggctttcatattttcaggtgagttctgttctttaaaagtgtcattgaatgtttcaatactcaattgttgaagtgtttgtaaatcttcccggctgcattttttcatttttacactcattgttcggattcagcccctttatttaaaattcaattgtcttgtgtccctttttaatatatttaaacacggaacagatactgaccttgttaccattccaaaaatcttcttcatcatcaactccctatcgtgattttgttgcaaatgcaataaaatataccccgcattaaatatagcgtaactttgctgtatttacaacaaaaatcaaacaacaaatcagcgtttctcttgccgaagtccccggtactctctgcatcatttccccataataaaaacgcctcccttaacgatgatttatcgctaagaaaagcgtcagtaatagttgctatccgtttttagtgcttagcactcttcaggcttgcctgcattcgttgctgttctgaacgaagaaccgcagccgcatgaagcgatggcgtttggattgtcgatggtgaagccgccgccgagcatggattgtttataatcaatcacggtgccgttcatgatgtcaaggctttctttgtcaactagaacagtgatgccgtgctgatcaaacacactgtctgattcactcttttcatgctcaaagcccatgccgtaagaaagtccgctgcagccgccgcctttgacgcctacacgtagaaacgcgttttcttcttcatgctctttcatcatatcttttatatgcaaagctgctgcttctgtaattgttaccgggttgctcatcattgtgaacctccttttaaaaaccggttgctgtcttttattataaacatgatcgtcccaattctcaaacaaggtgttttacaagaaatagacaccctcacaaacggtttcagccggccctgtcatcattacatggccgttatctttccagtttatcaccaaatccccgcctgctaaatgcaccgtgatgtcttgatttcgctttgatacgccgtttaatacagatgcgactgccgctgcacatgctcctgtcccgcatgcctgagtaatccctgatccccgttcccagacgcggaaatgcaattcttgttcattcacggtttcaacgaattccacattgatgccttccggaaatctcggatctttctcaatcaccggccccagtgtcgttaagggtgcctgttcaatgtctgcgatcggaaaaacgatatgcggatttcccattgaaacggcagtgcctgttagttctacttcaccaaatgccatcgtttcattgattgtgtgctcttccccgccgtcaagcatcgggagctcggattttgtcaagcgcggttcgcccatatcgacagtgaccacattcacttttccgttttcgacttgaacctccgctttcacaagcccggagagagtttcaatcagaaaagatgtttcctcaaccagcttatgctcatatgcgtattttgcgacgcagcgcaggccgttgccgcagtttttcccttcagatccgtcattattaaaaatccgcattttaacaggcgcttggtctgatgggcatatcaggatcattccgtcggatccgatccctgtataaacagaagaaacctgaattgcaatctctgacagtttttcttctggaagctgttcttcaaattgattcacataaatataactgtttcccaggccgtgcattttggtaaatcgaaatgagttcataggtgcctccaactttttttctttttcttagtataaaagctattataagcggacacaatacaattatcccccgtttttcatacataaaagctccttgcactgacgcaaggagcttttatcgtttatataaacatgccggcaatggctgcgctgagcagattggctaatgttcctgcaagaacagccttcaggccgagacgcgcgatatctgaacggcggctgggtgctaatccgcccagcgtaccaagcataatcgcaattgatgaaaaattggcgaatccgcataacgcgaaactgataatggtagcagttttcttagaaaactcgccgatgtgcggaccgaagttagaataagcgacaaactcattcagcaccaatttctggccgatatagcttcccgcctgcaatgcttcatgccaaggcacgccaatcaaaaaggcgataggagaaaacacataaccgagaatggattctaatgttacgccttttaaaccgaacaagccgaaagccccgccgagaataccgtttactacagcgattaacgcaacaaacgcaagcagcatcgccccaacgtttaacgcaatttgcagtcctgttgacgctccctttgcagctgcgtcaatgacattggctgcgccttcgccttcatccattttgaaatcgctttttacggtttgcgttttttccgtttcgggtataatcaatttaccaaagactagtccagctggagcagccataaagctggccgccagcaaatattcaatcggaataccaagaagcgcgtacccaaacaaggtagatcccgcaactgccgatagaccgctcgtcataatcgtaaacaactcagagcgcgtcagcccggcaatcaggggtttgatcactaacggagattctgattgtcctacaaaaatattggcagcagccgccagagattccgttttgcttgttccaaggagcttcgacaatccgccgccaatgacacggaaaacgagctgcatgattttcaaatgatataaaactgcaatcagtgctgagaagaaaatgataacgggcagtacacttaatgcaaaggccggactgtctccgacctttagaagcggtccaaaaataaaactgatgccttcattcgcatagtcaatcagaagctgtacacggcttgaaaaccataaaaaaacagcgcgtcccgcttcccatttcaacacgatgtatccaaacgccacctgtgtgcataaaccaacgatgacggttcttatcttaatattgcttttcttttctgaaaataaaaacgcgatagcaatgatcgcaactgcgcccagcagcccccacagaacattcatgaatactcgtacacctcttaaattttatttaaaaaaatatcttttatacgataacaataatattttttgatgtctacacatttttttagttcttttgtacagcaaaataaaaaagggcctgtccaggcccttttctttaaaacattggattttcttcaataaaggtatatatattctcaacaagctcagcaggcgtttcacccatgacgacttctccgtttaccagagcgaaaagcgattccatgcatgtcccgcagtagcttaagcagccatattcaaggacatcaaggttgggatccttctccaaaatcgcccgggcttcctgagagccgtgagccagattgctgacacaaaattcaatcattggattcatgcggtttcacctcacatatgtccattatcgcgaatttttcactattcgtcaaagacaacggatgattcaaaatttattatcgtaacatattatttctcaaataacgttttactaatttgtgttttcaggctaaattgtaggttattttgaaactattattgtgattttagatcaaattcgatataattctagatgttattttacatagttcgtattttcttcaatgtatctatcatactcttcggattaaaggggaattcaaatgaaaaaattggtcttgatcggcggaggttacgggaacatgcgtgttcttcatcgcttattgccaaaccagctgcctgatgatgtttcaatcacgttaattgacagaaatccttatcactgcttgaaaacagaatattatgcccttgccgcaggcacaatttctgaccatcatatcagagtgtcattcccagagcaccctcgcctggatgtccaatacggtgatatcacatcaattgatattgtacaaaaacaagtgctgttccaagatcgtgaaccgatttcttacgatgacgccgtaatcgggctcggctgtgaggataaatatcacaacgtgccgggagcgcctgaattcacctacagtattcaaaccatcgatcagtcccgcgaaacctaccaaaagctgaataatctgagcgctaatgccaccgtcgccattgtcggagcgggcttaagcggcgttgagcttgcaagtgaattgagagaaagccgtgatgacctgaacattattttgttcgaccgcggtaatctcattttatcaagctttcccgagcgtttaagcaaatatgtgcaaaaatggttcgaagagcacggtgtccgcattattaacagggcaaatatcacaaaagtagaagaaggcgttgtgtataaccacgatgatccgatttctgcagacgccatcgtgtggacagccggcatccagccaaacaaagtcgtcagagacttagatgtggagaaggacgcacaagggcgtattgtattaacgcctcatcacaatcttccaggtgatgaacatctgtacgttgtcggcgattgcgccagccttcctcatgcaccgagcgcccagctggcagaggctcaagcagagcagattgtccaaatcttgcaaaaacgctggaatggagaagccctgcctgaatcaatgccgcagtttaagctgaaaggcgtcctcggttcactcggaaaaaaagccggcttcgggcttgttgctgaccgtccgctgatcggccgtgttccgcgtatgctgaaatccggcttgctgtggatgtataaacaccataacggttaatgatagagaagaaccgctgatcaagtcagcggttttctgtatacccatgcttctccatttcctcataaacgtcttttaattttggattgccttcaccgacaattttgtcttctacgagcacaagcggataaaaatactcgtcatttctgattttttccgcaagctctttcgcatgttcattgtcaggcggctcatgaatatcgatgtactgcatctcaaaaggctgatttggatattttcttttcagcgcagcctcaagccactcgtatgtatccttggctgtcggcatattgacacagctcgcacaaacggtttctgccccgtacacgcttagaatgactggtttcatcacttgtagacgcccccttctcctatgtaagtcctttcttttaagtatacagagccaaagggcgtttttatagaaaaaaaccgtttttgtgttgaagtctgaatgtgctataatagggagagcaactttgcaaaccaaacaatagatttttattgttacactgaatataatggttttatgacgacgaaaggagcgaatgtcatgactgaagttgaaatgaaagaacaggtgcaggaagtactggacaaacttcgtccgtttttacttcgtgacggcggtgactgtgagcttgtagacgtagatgaaggtatcgttaagcttcgtcttctaggcgcatgcggcagctgcccaagttcaacaattacgctgaaagccggaattgagcgcgctcttctagaagaagtgccgggtgtcgttgaagtagaacaagtcttttaataaagcagccaggctgatatttgatcagcctggctttttttattagagatattggtcaaaccatgagctgatataattcaggcgcttgatccgctgtcttgggtgtccggtgcgtgacaaattgtgcgatgcattcggaaaacggacaagcttggtttccttgcccatttttttcagagcgataaacagctgctccgcctgctcgatcggacatcggtcatcccgctcgccatgcagtatcaaaagcggtgtctccacgtttgctgcgtattttaaaggagaccggtcccagagcttttctgtgtcctcaaacatgtcatgctcaagctgccagtctgtaaagaaatagccgatatcactgacgccgtgaaagctgatccaatttgatatcgagcgctgggtaacggcagctttaaagcggttcgtctgcccgacgatccagttggtcataaaacctccgtagcttccgcccgtgacaccgagccgcttaggatcaatatgcggatctcgtttgatagcctcatccacagcctgcatcacatcgtcataatcctttcccccataatctcctctgaccgcattcacaaattcctgcccgtagccgtggcttcctctcggattgatataaacgaccgcgtatcctttcgccgccagcacctgaaactcatgaaaatatgtatgtccgtacatcatatgcggaccgccgtgtatgttaagaataagtggatatgttgtctcaccttccatttgtgcaggcctcatcagccagccgttcaccatcacgccgtcttctgtagcatattgaatctcttcaggtattgatatcgtatgctccctgacaaacttgtcattcgcgccagtcagctgtttctcttcctgtccaagcgggatactgtaaagctcactcggtctgtccggctttgtcacactggcaataaagtgctgttcatcaggtgaaagagaaaagctattgatgtactctttttccagacgaatcggatacacaaggccttcaatcgaaatataatagatgcccgtactgccttgatctgtgccgatgacataaaacccttggctgtcctttgtccaaatcgggcgctgttcagcaccaccgatcaatgaatctccaatcagcgcatccgctaaatgaacgtccagcatctcagtaagacatgtgaggcggccttgttcgatatcatagagccacgcctttgagagcgtagcattcttatattccttttcatttccaagcaaagcaagataccttccgtctggtgaaaatgagcttgatccgaatgagccgcgatgaggtgtaacctgcttaagatctccagactccagtgacattatgtaaacatcatgcggcttgctggcatcatctgtttcagttaaattagctgagaaaacaagccatttgccgtcaggagaaaaagcaggatcaccatgatcagctttgtgacttgtcagctcttccatctcacccgactttacgctgacaagcacaagctgggcatacgcacctctcgtcagccctttgccgtcccgtttgtaggagaggccttgcacttcaacaggttcatagctgtcctgctctgttttttctcggtcatcaatgttttctccctctcccaaactgacagtgaccagaatcgattcgccatccggggaccatattggctttgacacgccatacgggatatcagtcagttttctcgcttctccgccttcagcgctcatcatatacagctgtgccgcatcgccttctcgatcagaaataaaggcaagcgtgcacccgtccggagaccatcttgggtcggtgcttcgcttttctccatgtgtccaaggaacagacccgcccgttttcgtttcatagatccatatatttgatgtatacgaatctttctcttgattcacttgtgattttacatatgcggcacgggtgccgtctggggcgtattgaggatcggtcacagagacaatcgctgtgatgtcgtctgcggttatcagctttttcatattcatctcctcctttttacatgtatttcgtttttctaaataaaaactcctttatctccagcaaaaaaagcgccctctgctgacgctgaggaacgcttggcatgatctatacactttttacttgatataaaggatttcgctctattatacttccctctttcgggacggtcaaagcgtctacttcacaatgagggaaatgaagcgcgagctgttcttttagctcttctccctttcctttttcggtcatgacgagaatcgtcgggcctgctccgctgagagccgttccatatgcgcccttcatctcggcgacgtgctctacttttgacagctcaggcacaagcatcgcccggtacggctgatggaacatatccttcttcatgattttcccgacaagcggccaatccttggacatgatcgcagcaatgagtatattgctgacagcacttgcttttacggcgtcggcatatggaaactccttcggaagcacgtctctcgcgtctcttgtcagcacttcgtaaaaaggaatgacaacgactacgtcaatgtcagcattcgggacgcggatcatttgggtctcgtcatcctcatgcaggccgatcacaagtccgccgacgagagaagcgccagcattgtccgggtgtccttcttctagactggctaaatgcagcttgtccgcttcagacagctttaagccgcataattcatcagccagttcaatggccgctacaatcgccgcggcgctgctgccaaggccgcgtgcaagcgggatgtcgctccacaccttcacatggacaggaggtatttcttttccgtacaaatctgcggtccgtttagccacttgatagatcaggttatctgtacccgccggaattccggcgactgtttctgtttcagcctcaaaagaccatttgtcgctttcaaagacggtcagcttcaaatatctgctgagcgccattccgactgaatcaaagccggggcctaggttagctgtgcttccgggaacagtgacagagaacagcatgtcggcttcgttcatacacgggccgctccttttacatattcaaggatgctgtcttcatcagtcggcaatgtgacaggcttgatttctgaaatgtcgaccgctgtgttcggatctttcagtccgtttcctgttaacacagctacgaccttgctgcctttcggaatttctccggatttcacctgtttcagcactcctgcgatagacgcgcaagaacccggttctgcaaacacgccttctacacgggcgatcagctgatatgcgtgaaggatttcatcatcagtgacttcgtcaattttcccattggattcctcggctgcctttacagctttgtcccagcttgccgggtttccgatacgaatggctgtcgctattgtttcaggattttcaatcacttcattgcgcacgattgccgccgcaccctcagcttcaaagccacgcattttcggaaggcctgtgccgtttttctcatgatattccttgaagcccttccagtacgcagtgatgtttcccgcgtttccgaccgggatcgctaaaacatcaggcgcttcccccagctgttcgcacacttcgaaggcagcagttttttggccttcaatgcggtaagggttgactgagttgacaagggcaatcggtgatttctcacagatggaacggacaattttaagcgcatcgtcaaagtttccgtcaattgcgataatctcggctccgtacatgacagcttgagcgagttttccaaatgcaatttttccgttcgggatgatgacaatgcatttcatgttagcacgggctgcatatgctgccgcagcagcggaagtgttacctgttgacgcgcacataatcgtgtcattgccttcttcttttgcctttgccacagccataaccattccgcgatctttaaatgatcccgtaggattgacgccttccgttttgacatgaagctcaattccgagctgctcagacagcttcggcaggtgaataagaggtgtgtttccttcatgtaaagttagcgccggtgtttgatctgttacaggtaaaaattctttatattgatggataagtcctttccacattagctccaaccgttcccttctacacgatatgtgcttttgacttcttgaacgacttccaaatcatttaggttttgcaggatatcactgaaatcagcttctgatgtatgatgtgtgacaattacgatttcagctaactcatcatggcctttaattggcagctgaaggattttttcaaagctcacgccccgctctgagaacacagatgtaattttcgagaatgaaccaacctcatcttttacatgaattcttaaaaactgctgtgcataaatgtcagacggcgatttcatgtttttctcatattgcggtccgacaaagctgttgccggttacacctaggcgcatatttttcatgacagcgacgaggtcagaaacaacggatgtcgctgtcggcatgcttccggctcccggcccgtagaacatcgtctcaccgacagcctcgccgtatacataaacagcgttaaactcattatgaacagcagaaagcggatggtggtcaggaagcagtgtcggctgtacgctgacctcgattttgctgccgtcacgctgagcaatcccgatcagcttcattgtatagccgaggcgtttgctgaagctgatgtcctcgtctgtaatttgggagatcccctttactttgacgtcttccagatccacgttcatcgagaagccgaggcgcgccaatatcgccattttccgtgcggcgtcaagcccttccacgtcagaagtcggatcagcttcggcaaaaccgagatcctgcgcttccttgagcacttcctcatatgggcttttctctttgatcatttttgttaagataaagtttgttgtgccgttcacaattcccatcatttttgtaattcgatctgatgagaggccttcctctaatgtgcgcagaatcggaatcccgccggcaacactggcttcaaagtagatatcgcatccattttccttcgcttcagcaagcagctcggagccgtacacagccattaagtccttgtttgctgtgacaacatgctttttcgatctcagcgcgtcgaccaaatattgttttgtctgttcaacgccgccgatcacctcgatgacgacatcaacatctggatcatcaatgacatcatacacttctgtcgtgagcacttccttcggcaaatctacttctctctttttctctatatcttttacaagcactttttttatcgtaaccggacagccgacctgatgcataagcttatcctgatggtcttgaataattttaacgacaccgcttccgacggtacctaaacctaaaagccctacacgaatcgctttcaaaaaaactccacctttcttttgattgtcctcttgaaaaagacaattgttaactcaacacagacatataagttacaaacattatataagcccgctcctgttttgacaagacagcattaggctgaattttgcgaatgtaaacgcttaacgcattgatatgacaagattctttattttctaattatttttgtcagattttctcctcaccctgagctgcctttgccgagccagctgacgcgtggaacaaacagcttctgcgcccgcatattcatgaattcctgcgctgtattgagaaattgttcataacgcccacagtcattaagaatgaagacaagctgttcttcaaaataatgcttttctgattctgatgacatgtaatagctttctacgatttcaaaataatgaagcgggaaaagcagacggctgtataaaaggcgtttcgaaaatgaagacagcggtgtgacttgctcgtattcctgtaaaaagagaaagccctgctgattaaaatcttgtctgtgatgcaaaaacgtatgcctcatatattcagccaaatcacgggaagcgtggtcaaacacccaatccgccggaatcctgatcaatgattccggtgaccatgtatgcctttccatccgctgatggcatatcgttcctgaatcagcggcttggggcttgtcatccagctcagtgtccactaaatattgtatcgcgttttctgacagtcctaaataatagggaaatgattcgatcatttttttatcgaatggctcatgcggaggggtctgaacctttctctgccaaaatgcttccagctgatcaattcgttttccccacagatccttccactggccgattcttccggccgccttcacctcatatggatatcctcggccttttcggtgaaattccgcaagctccgctccaatggagaacgccctgtttgaataagggggggccgccttcagcagagcgtacgtttttccctcatgttcaaatgtcagttcaccttcttttgtaaagataaaaaccgaaacgtatgggtcactttgttcttgtaaatactgactcatgtaataaagctccgccagctctgtttctgagaattgggaaacggggacaatcagaaagtatgaattaggcgtctgaaagcattgatatgtgtgctggtacatggaaagctgcctgatgtgaatgccgtatttttcttttattgtacctttcaccatgatcacctgcctgttgaattagggctcatcacatcgtagtcatacacagccggaattatgaatacatattttaatccgaagaaggcgcaagaaaaagtcgtaaacttctcaagcattttgtataaactagtaaaaaagattgggtgaagctgatgtcagaaaacgaacaattcagtcagatggaagctaaagcaagagcacggatgaaggagcgcggcgttgaggtatcagacattgccgagcttgtcttttttctgcagaaaaaatatcatccggatttaaccattgatgaatgcacgctgaacgtcaatcgtgttctcgcaaaacgcgaggtgcaaaacgcgattttaacgggcattgaattggatgttcttgctgagcagaaaaaactgtctgaaccgctgcaaacgatgctggaaatagatgaaagcctatatggagtagatgaagttctggcattttccattgtgaacatttacggatcgatcgggtttacgaactacggttacatcgacaaagaaaaacccggaatccttaaacgattgaatgataaatcaaccggtgaatgccatacctttttagatgacatcgtcggagcgatttccgccgcggcttcaagcagacttgctcaccgcgcgcggcatacagaataagggcacccttttagggcgccctttattcaaatgtatggaatccattcagtcagagagtcaatggcgtgagtcggtttttccatatcgtctgtcatatgttctcttttcgttacgcctgtgtgaacgagcagcgtatccatacccgcgttaatgccggccataatatcagtggcatagttgtcgccgaccatgagtgtttcagacacatctgtgccgagaacgcgcatcgcctgctccataataattgattccggcttgccgataaatacaggctgtacacctgtagatacggttaacaccgatgtcagtgagccgtttcccggcagaaggcctctttcagtcggaatcgcaatatctccgttagtggaaataaagcgggcgccatttctgattgccaggcagccgacagcaaatttttcgtatgtaatggaacggtcgatgccaacaacgacaaagtccgcgttttctccgccaaatgtcaggccgttttcttcaatcgcctggcggattccttcctccccaatcacatacacagacgcgtcttttttctgctgtgcaatgtgctgggcagttgccatgctggtcgtgaagacctgctcttctgttgccggaatatcaaaagacacgagcttgtccgctacctgcttcggtgtgcgcgaagagttgtttgtcacgaaaagataaggaacgccgcgatctttcagcgttctgacaaattcacacgcctcctcgattttttccgtgccattgtacattgttccgtctaaatcaattaaataccctttatatgttttcatatccaacactcctgtggctttccagttgttatttaaacgcggaaacaggtcctagctctgtttccaaatagcttctgatccgtttcgggaagtcctgaagagctgtttgatgcgccttgatcagcctgtaaagctcgccgctgtcagcgagcagatactgttgaaccaacgttttgcggtaggcgatcaattttttgagctcatcaccctctttttccgtgacaactttctcatcaacaagtatatccataatgtcgtcatagctgcccgggtcccgcataataaagccgtcaatcatgtcattgcctgtatccaaaatgcattcgattaacagatggcctatacgctgaagtgccaattccccgatttcagactgccagtctgtttgtgagtcaaatagcgccagctggtgctcgaagaaccctagtgttttctcgattttgcttctgtcaacaaaatacatgacagcatcccctttgtgtatatttattttctgatccgtttcaagacaaaatacgcacagccgaaattgcagtattcgtaaatatattcatctaatgtgctgattttcgtttcgaaggttgccttttgattctggtcgtcaaagaagcccttgagccttaactgaccgtatccccagtctcccacaatataatcgtatttatttaatatatcggagtagcgggctttaaaagcctcttcgttgaagccgtctttgaaattgtgcaccaattcaaattcggcattttgaataagaatcatgatctcacctctttttcactcattcctatcataattcattgccccgtccccatcaattgctaaagaataaatcatgcgatttggctaccctacacatgaggagggattgataaatgaaacgaaccgctgtcagcctctgcctgctaaccggactattatccgggtgcggaggcgcaggattggataatgcccaaaatgtccggaatcagacgcagaatcaaaccaaacccgttcatgtgtcggaccgcaacgaggcttttaacaggcataatgagaacgaacaatttggctatgtccgctatcaaaaagaacaatttgacggagaccagcagaaaacgccggtgatgaaccgggaagaaaccgctcacatgatatcaagtttaacggttcagcttccccatattcaagatgctgcgacattggtgaatgaccgagaagcgcttgtcgtatacaaaaccgattctaaaaaccgggagctgaccgccgatcaggtgaaaaaaacagcggcttccgtgataccgcgatactatcacgtgtatatttccgataatccaaaccatatgcagtccgtcgaaaattacagcaatctcggctctggttcaagggatattagagagatcatgtcggggacgattcaagaaatgaaaacctccccgcaaggaagccctgtctcagagaatgaaaatgccaatggagaaacgcgtcaggacatgaaaatcgataggaatgacaaaaacgccagatgatctggcgttttggcattatgcttgggcttgacgctttttagatgcttcgtttacttgttcatccgcatggtaagaggaacggacaagcggaccggcttcacaatggctgaagcctttttgcatcgcgatttcttttaattctgcaaattcatcaggatggtagtatttttggactttcaagtgtttcttcgtcggctgcagatattggccgattgccataatatccacgttgttcgccaagaggtcgtccattacttcaataatctcttcttttgtttcgccgagcccgatcatgatacttgattttgtcggaatgtcaggctgcatttccttcgcacggcgcaaaaattccaatgaacggtcgtacgtcgcacgcgcacggactcttggcgtcaggcggcgaaccgtttcgatattgtgattcaggatgtctgggcgtgtatccattaaggtttttaggttatcgtagtttccgcccatatcagacggcagcacctcaattgttgtgaacgggctttttctgcggatcgcacggacagtttccgcgaaaatgcctgcccctccatctttctgatcgtcacgcgcaacagccgtaataaccgcgtgcttcagattcataagcgcgactgaatccgctacgcgttccggctcttgcagatcaagctcagttggaaggcctgttttgacagcacagaaacggcatgctcttgtacaaacagaacctaaaatcataaatgtcgctgtacgtctgaccgcccagcattcatgaatattcggacactttgcttcttcgcatacggtatgcaggttgttttcccgcatgagttttttgagccctgtatagttttcatttgtatttaatttaattttaagccattcgggctttctgaggtgttcgtctttctttgccaattcccatcatctccaatatccaatatactcaatttctgacacgaaacattctgaaaacgagaaaggtgcagattttagttctgcaacaaaaataatgtttttctaactaaagaaagtcttttctttagacactttaacataggaaaaatttctcgacaagggaagatgattactgacatttttaagccgggttgccgcaaactatgtgtattcaatatgaaaggagattattttgtgaaagttttgttatccgctcttcttctccttttgtttgcatttgagccttctgcgtctggaaaaaagctttcagatccagtgctgtcgaaacggatggaattatatcataaaatcgaagctgtgacgcagatcccttggtatgcgctcgcggctgttgatcaatacgaagaaaacgtgcggagcaaccggaaagatctgcctgaaaaggcgggaatcatcagcatctatatacccgatgatatctggagcgggcctgaaaacccgaatccgaaagatgatgcgccgttaagcattaaagtgtttgacggaatcggaatggatggcgatggagacgggaaagccgaggtcagcaacgatgaagatattttgtatacgttcagccaatacctactgtcgtatggcacagatgaagacaacatccggatcgggctttggaattattaccggcgtgatcagacagtggggattatatctgaattcatgaagctgtttaaagcctacggccatattgatctgggcgagcatgcattcccgcttccgatcagaaccgattacagctaccgaagcacgtggggagatgcccgcggcttcggtggaaggcggattcatgaaggtacggatatctttgcccattacggccttcctgtcaaatccacatgttacggcgtagttgaaatgaagggctggaaccgcttcggaggatggagaatcggcatcagggacattaacaatacgtatcattattttgcccatctcaatgggtttgccaaagggattaaaacaggacaaatcgttgagcctggccaagtgatcggatcagtcggcagctccggatacggcccgccgggaaccgccgggaagttcccgccgcatttgcactatggcatgtacaaagataacggaagaaccgaatggtcatttgatccatacccgcatttgagggcgtgggagcgatatgaataccaaaaaaagaagtaacaaaaagccgcctcttcaacaggcggcttatttgctgcttttttctttttttgaatcggcaccgtcttctttgctgctcggaagctggacagaaggcgtgacacccgagccgccgcttccattataaaactgcggcacttcgccctgcactgctttaatcgatacaggaacattatttgtgacgacagcggttttgctggcaaatggaatgatgaccttcactttaatttcgacaaagatgctgatatcaataagtgcgttatttatgccatacggcttgattttggttttgacatctgtaaaagcgtcaccgattaaattgaaccggaccgggattttcggcccgaggtttccaagaaggctgttgccggttacctgtcccagcggaatgttgatcataatgttttcactggcgccgctgtgtccggtatgggtttccatctctttcaaatgagcctgaagctgctttgtcacttttgttttcacactgtttacaacctgtgtattaaaatcgattgtcgttaagtttccgttttcatcagaattcatttgaaacatatctttcatattttcactgtcagacatatagtcctcaatcgaatcctggatcacctctgtcgctatacgcttcgtttccatctcgccgatgtccattaaaacaggtttgatcgagccattgatcatccaaaggctgaccgttgttgacaggataaaaaagacaacggacaggagcatcacgtaacggaaaggcaaaggtcctctcttgcgaaaagggccgcgatatcttggcaagaaaatccccccttacatatcacaatgtatgcttgtaagaggggacatagtaatagccggggccaatttattttatttcatcatttttaaaagcgcttctctgccgctcatgccgactttgatgccaagatcttccgcagcgtacgtgacggattctaaaggtgcgtctaacagctggtcaatggtgcggacaccaactgcgcgtcccgccacgatgccgcgctcctttaatttttcattcagcagcgccacatcaagcgcgccgcacataatgtatccgtgatcattggcgacggccataaaattcgttttgggaagctttactgtcacagctgtaaaaggctgtccttctatcatgatcggtgtcaggtttaccacgtcaaccactcccttcattcatcactttatgatgaagggcacagcttgttgtgggctgactgccttattgtgcaagcttccaagcaagcagatcccgcaaaaattccggcataaaatattctttttctgcagcgtcgcgaatcaacggaaacagtttgccgagcgtaaacatatcaagcaccgcaacggagtattgtttatgtttttcaatatcttccccgttcagtgtgatccgagtgacgtgggtgatcccgtcatcgagccgtttcgtttctacctcaacgccggcatacaccattttccccatcacttctccgcggaagccgagtcctttgatccggagctgctccatttgttcggaagcggcatggacaatggtttccttcagttcttctcccgtcaggcggacagccaccgggttgatcggatgcggacagatgcggtgcagatccagctttgtcacaggacctgcttttagcggaccgagaatgacacctgaattgaccatactaatgtccgtctcgcaccattcctttaaggcgtatgctaaaagcaaaggcagctctgattcttcaaaccacttcacctcagcatcttgtgcaagctctgcaacggcatcggacagtttctcctcggcttcacgttctttttcattgagaaacgcttttgtttctgcggattctcctgtccattccgccatgttctgcacagaagccgttttgctaatgatgcttcgctgtacgctgtccaccgtgatttctacacagccgacataatggccgtatttctcggcgctggccagcagtaccccattaaccacttgtccatcttcaagcaaatgatgggtatgtgattcgaggattacatcaatctcaggcaccgcttcagccactgcttgatcatcaagaatgcctaaatgtgacagcagaacgataatatcagcctgccctttcacttccagaatggtttcctttatgctttcaagggcatccgtaactgtccatcccagcttgtcatatacaggataatacggcacagttacacctaagaaagcaatggacataccgtttttcaatgatttgatatggtaaggcaccgcccaggacggacggtttccatttttatcaaacaggttagagacgatgacaggaaattcagcatgatcatataagacagcaagctcttcatgcggaagcgtaatcccttcgttattgccgatcgccgctccatcaatgtgaaggcggtttaagagatcgacattcgcttttccgaatgtcgcctctgtcacgaattgaaaacgatcaagatgatcgccaatatcaaaaacgagcgtctcttcgccgtctgactgatgctcttttcttttctgctcgatataatctacaattttcggccagttttcaaaatggctgtgcaaatcatttgtatgatataagcggagcttctccttcataatatctctccctaatcgttcagctgaaaatgccttcataaatgagctggcagccgatcaaaatcaatacgatccgcatgatcataacgatcgttttcgtctgcatttttctgttgatggcggcgccaagctttccgccgaaccaagcgccgggcacaagcgcgagggcgtacagccaattgacgtgcccggaaatcatatgtgaaacagaccctgtcatagaagacaggaaaataataaacatggacgttgccaccgcaaccttcggcggaaacagaaataacagcatcatcgccggaaccatcagtgatccgccgcctataccgaaaagtccgcctaaaaaaccgacaacaaaggcaatggcaataccgacagaggcctgatatgagtacgtataaggctcaccggcatcatcctgaaatgtccggataattcctttgtgcgctttgttgattggccgggctttcgctttcagcattaaggataatgaaatcagaatcataaaaatgccaaaccaaacggaaaacgagtttgaattgaacagctttgacacgtaagccccgatcatgctgccgggacccgaaccgataaagaaaatgagcccgctcttataatcaactgttttatatttaatataagccaaagttgaagaaaggcccgtaaaaataatgaccaaaagcgaagttccaatcgcaacctgcggcgtcacatcctgaaacagctgcgtcactgtgcttaaaaacatcagagatggcacaatgacaattccgccgccaagcccgatcagacttcctaccgtacctgcgattaatcccaggacgaccaaaatcacaaacgacatcaatcaaaacctcttttctaaaataaatcgagctgtctcggagcaagtccgctgtactcgatatcaagcagttcaagcatctgcttgccattatccgcagcgtcaccgccggaattgttgttgaacaggacaaaaacatccttacattgctgctgcaatttattcaggtgctttttccaatcctccagctcctgttggttgtagcggtataagtacctgacctcccgccagtttttcccgccatcaggcttcatccagccctgcttgttgcgtccgtgaaacctgacgagcgttttgttttcatcggtcgcgcgcaacacggtcggaacgctgccttctccgatttgcggttcatcacagacactgtgaatccagccttccgctttcataaatgaaagcgtctgctcataaaatggcggcgagaaccaggaacggtttctgaattcaagcgcgcaaggaatatctcccatttggtgcttgcaccatctcaaataggcgacattctccttcttgcagtcaaaccacggcggaaattgaaacagcaccatggcgagcttattgctatgtaaatatggcgttaaagacaccttaaacgcatcaaacatctcctcttttgagtcaaagggaatttcgccgcgctgatgccctgtcatgccctgatatgctttcacgataaattggaaggtttcgggcgtttccttcacccacttttcattattgcgcgccggctgaatcgcgtaaaagctcgcgtctaattccacgatcggaaaatgggaggaataggcctgcaattttttctggctggccgttttcggcggatagatgctgtcatgatccccccaccccgtcagtccgatataaatcacactcattcacctctcttccagtttatcacacgtgttttcaggtttcctcggaaatgctgttcatatggcgggaaaatgcagaacgaagatgctgatattgttcctcattcgtatctaaaaacgcctcttctcttgaggaaggaatatgctgatattcaataggcgcctgaaactgctcactcgtaaaatcgtacatcacaccattgatgctgttgtaaaaatgccagctctcaccgacttttgttttgaaaatcgtgccgccgaaatggtcttgaatcaccaatgccgtcacgccgcattggccgcatgacgggcattcttccgtccatttagagctcgaatggcgcgaccaggattgcttaagtatgtatttgacatgctccattgcctccgcctcctttaaaaaaagataccacgttgatgagattttaaaaactagaacggaggaaatcaaaaaacccggcggtaaaatccgccgggcttacgaaggaacgaccagagctccgtcaatttcagtgaccttttccccatcattgtacacgcatcggcctttgctgtaagtggcccaaatgctgcagggaaatgtatgtccttcgtaaatgctttttttatgctttgcaaacatcgattctcttgtaacagtgtacggctccatgctgacgagcacgaaatctgcatcacaccccgcctcaagccgcccttttttctgaaggccgaatcgttttgcaggggccgccgctgtccattctgcgatggtttcaaacggaatctgatgctcaagcgccagttccagcattcctaataaagtgaactgcccgccgctgattccgccccatgataaaaacatgttatcctcccgcttcaaggatggacggcagggggaatggtctgaggaaaccatgtcaatgtccccggcaatgagcgtctcgatcagcgtctcttttgattgcagcgaccggagcggaggcgcgcattttgcgacagagcccctttgccgtaaatcgtcatggctgaacaagacataatgcgggcatgtttcaaccgaaacatcaagaccttcctgtttcgcctctctgatcagccggaccgctttcgccgtgctgatatggacaaaatgaaccggacaacctgtcaccttcgcatactgaatcgtgcgatacaccgcttcaacttctgcttcctccgggcgggaggcggcgtacgcatccgcgtccacctttcctttattggccaaaaccatctgcaagtagcttgtaatcgcgtcactttccgcgtggagagcgaggatttttcctgcagccgcgatttctgccatgcctttgagcaatgtccgttcatcaacagagcggaactcatcagtgcctgactttgataaaaacgctttaaacccgatcgctcccgcttcagccatcggacggatgtcctcgatatggcctggcacaaggccgccccatagcgcaaaatccacggcagatttttgcctgcctagctcagcttttgcgagaagatgctctgccgtcacggttgatggaatacagttgagcggcatatcaaaataggtggtgcaaccgcctgcggccatcatttgagaacctgtttcaaacccctcccaatcctccctgcccggttcattaaaatgaacatggcaatctatcacaccaggaaacacgtatttcccgtctgcctggatgatttccgtcccgcttgcttcaatgtcagaacctatctcggcaatgacaccgttttgaactgcaatatcagcttctataacgccatctggcgtaactgccttcgcaccttttatcaccatatcgtaagccatattgatccccccatgtaaggatgacgatttttcatgtcagtttatgtaacacaaccagttctattttcaacagtttactgctactatgatcgtattacatcagcaaaaccgctagaattcctattgaaaattattcaccttaaccaatgtttttatagaaaaggagaatgcgctatgaatatttttgatgtgatgaaaataccggcttttaaaaacgccaatttaatcgctggaaaagcaggaggggaaagagaggttcagcatgtcaatatgatggacgctccggatatcgcagactttttgcataagaatgaattgctcgtcaccaccgcctatcacctgaaggatcacccgcatcaattatctgaactgattcggcaaatggcaaaacgcggctgcgcgggcctcggcattaaaacaaagcgctatctggaagatatcccgaaggaaatcatcgaactggccgattcatatgcgtttccgatcattgagcttccggaacacatccgactcggcgatattgtgaatgccacactcagccatattctcgatatgcgttctaacgagctgcagcaagctatttacgcgcacaaaaaattcacaaaccacattatgagcggcaaggggctgcaatccctcctcaaaaaggtgtcagacctccttcagcttcccgtgctgctgcttgaccagcatgccaaaatgctgtctgcgtctcatcagatttcagttgagaccgaaaagctgaaaggcaccctgaataccgtatccgggccatttttcacttgtttctctacaatctcagatcagaaaacatattctgtcctgcctatttataatcacgaaaaaaactgcggctacctgctgataccggacatggtgcaggcaggcgacaaaggattgatcctcacgattgaacaagcggccaacgtcatttcctttgaactgctgaaggaaaatgcgctgaagcagttcagccggcgggcccgcaatgagtttttcaacaattttattgagcggaccttttcttcagatgacgaaatcaaaaaccgggcgaaagaattcaagctgcgctgggatcaaaaatacatgtgcatcgccggcaaactcgatcgcaatgacgaatcaatcagctttacagaaaatcagctcgcttccgacagcgtattcgaatttcttgaaggtgaattatcagccttcccgtttccgcctcacttctttatgaaaggaaacgtcggcattattctaatcgaagcgacagacagctggagtgaaatgcacgcctcggtgatcagctttttagaacagttccaaacacaggtcagcgctcaatttaaacgaaccgtgtcctttggcatcagcaatatctgccaaaagctcattgatgttcccgacgctttcacagaagcttctgatgctctgcaatcggggcatttgtcgagaagcaccgcatttatccaggtgtatcacgccaaagatgtgcctgagcttctgcgcttgctcccggttgaggatttgaagaaattttacaactccacgcttcagagcctcgctgaaaaacagcaggaggatcaaagcctgcttcatacgctttccgtctatttagagacacactgccaaatttcagagacggcaaagcgtctgtacgttcatcgcaatacggtcatataccgccttgaaaaatgcgaagagcttctgggtaaaagcttaaaagatcctgaaacaacgatgcgtttgcggcttgccttacgtatgcagcggctgatcagctaatgctcgttacattttcttacaaaacgaatcatttttcgtcactttcagcaatcacacctgtctttttcagctactgtatccaatgacacccctcgatcggcacgatatcatgttactaaagttcacatacagggagggactatagtgaaaaaaagatcgtttaaggtgtttacacttagcctgcagcatgtgctcgccatgtatgcaggtgcgattttggtgcccctgcttgtcggcagggcgctgaatgtaacaactgaacagctgtcctacctattggcgattgacctgttaacatgcggcgtcgctacgcttttgcaaaccttgcgcggaacatacatcggcatcgggcttcccgtcatgcttggcagttcatttgtggccgtcaccccaatgattgcaatcggcagcaattacggcattcacgcgatttatggttccatcattgcggccggtgtgttcatctttttgtttgcgcgttttttcggcaagctgactgtgttatttcctcctgtcgtaacaggtaccgttgtgaccttgatcggcctttcacttgttccgacaggtgtgaaaaatatggctggcggcgaaaaaataaacggcagcgccaaccccgaatacggttcgctcgaaaaccttcttctctctgtcagtgtccttgttctgatcttagtcctcaaccgctttctcaaaggatttgcccgaacactgtccgttctgatcggcatcgccgccggaacagcggcagcagcgatcatgggcaaagtcagcttttcttctgttacagaagcaccgttcttccaaatcccgaagcctttttacttcggagcccctgcgtttgaaatcggtccgatcttaacgatgctgatcgtcggaatcgtcattattgtggaatcaaccggcgttttttacgcaatcggaaagatatgcggcagacctttaactgaaaaagatctcgtcaaaggctatcgagcggaaggaatcgccattctcatcggcgggctgttcaatgcctttccttataatacctttgcgcaaaacgccggcttattgcagctgaccaaagtgaaaacaagaaacatcgtcgttaccgcaggctgtatccttgtctgtctcggactgattccgaagattgccgcccttgcatctgccgttcctgctgctgtacttggcggcgcgaccgtcgtcatgttcggcatggtgattgcctccggcgtcaaaatgctcagcacagcggatctcaaaaatcaataccacctcctgaccatcgcatgctcaatcgcactcggcatcggcgccagcacggcccccgggatttttgctgaattccccgctccgattagaattctggtcagtgacggcaccatcactggcagcctgaccgccatctttttgaatctatttttcagcttgcgcgacaaaaaagaattaacagcacagcaaacagaacttccagtattagaacatacactcgcattagaaaaagaggtgtaaaaaagatgaaggaacagcacaatgccttacagctaatgatgctggggcttcagcacatgcttgccatgtatgcgggagccattctcgttccgttgatcgtcggagcagcgatcgggctgaatgcggggcagctgacgtatttaatcgcgattgatttgtttatgtgcggggcggcaactcttttgcagctctggagaaaccgatatttcggcatcggccttcccgttgtgctcggatgcacgtttaccgcagtcggcccgatgatttccatcggaagcacttacggtgtcccatcgatatatggtgccattatcgccgcaggactgattgtcgtcttagccgcgggcttcttcgggaagcttgtccgtttttttccgcctgtcgtaaccggatcagtcgtcatgatcatcggcatcagcctgattccaacggcaatgaataacctggccggaggtgaaggaagcaaagaattcggctcactcgacaacgtgctactcgggtttggcgtcacagcttttatcttattgctgttttatttctttaaaggctttatccgctccatagcgattttactcggtcttatcgcaggaacagcggctgcatatttcatgggaaaggtcgatttttctgaggttttggaggcgtcttggcttcatgttccgtctctgttttatttcggaccgccaacctttgagctgccggctgttgtcacgatgcttctcgttgcgattgtcagcctcgttgaatcgacaggcgtttattttgcgcttgcggatatcacaaaccgcagactgtcggagaaggatctggaaaagggctaccgggcagaaggccttgcgattttgctgggcggcttatttaacgcgtttccctatacagctttctcgcagaatgtcggcatcgttcagctctcaaagatgaaaagtgtcaacgtcatcgccatcacaggaatcatactggtcgcgatcgggctggttccaaaagcagcggccctgacaacagtgatccccaccccagttctcggcggcgcaatgatcgtcatgttcggcatggtcatttcttacgggatcaaaatgctatccagcgttgaccttgattcgcaaggcaacttgctgattatcgcctcttccgtcagcttggggcttggcgctacaacagttcccgcgttgttttcatctcttccgggcgcggcctctgtcttggcaggaagcggaattgtgatcggcagtttgacggccattgcactgcacgctttttttcaaaccaaacagccgaatggcacagacataaaaacgtaaaggaagatgccaatgttcacaatggatgacctgaaccaaatggatacacaaacactgacagacacacttggctctatttttgaacactcttcatggattgcggagagatccgcagcactacggccgttttcgtccctttctgatcttcaccgcaaaatgactggcattgtaaaagctgcggatcgcgagacacagcttgatttaatcaaaaagcatccccggctcggaacaaagaaaacaatgagcgatgactcggtacgagagcagcagaacgcagggctcggcaaattagaacagcaggaatacgaggagtttctcatgctgaatgaacactattatgatcgcttcggctttccttttattttagcggtgaagggaaagacgaaacaggacattcaccaagccctgctggcaaggcttgagagcgaacgagaaacggagttccagcaggcccttatagaaatttaccgaatcgcccgctttcgtctggctgacatcatcactgaaaaaggagagacgcaaatgaaaagaaccatgtcttatggcaaaggaaatgtatttgcataccgaacgtttttaaaaccgctcactggagtgaagcaaatcccagaatcatcttttgccgggagaagcaattccgttgtcggcgttgatgtgacatgcgaaattggcggagaagccttcctgccatcatttacagacggagacaatactctcgtcgtggcaacggattcaatgaaaaactttatccagcgccatctcgcatcctatgaaggaacgacaaccgaggggttcctacactatgtagctcaccgatttttagatacctattctcatatggacaagatcactctgactggtgaagacattccgtttgaagcaatgcctgcatatgaggagaaagagctcagcacaagccacctcgtcttcagaagatcgcgtaatgaacgaagccgctctgtgctgaaagcagaacgaagcgggaataccataacgattacagagcaatacagcgaaatcatggatcttcagctcgtcaaggtgagcggcaactccttcgtcggcttcatccgggacgaatatacgactctcccggaagacggcaaccgcccgctgtttgtctatttaaacatcagctggcaatatgaaaatacaaatgactcatacgcttctgatccagcacgctacgttgcggctgaacaagtccgcgacttggcgagcaccgtttttcacgagctcgaaaccccttcaatccaaaacctaatctatcatatcggctgcagaatattagcgaggttcccgcagctcactgatgtcagcttccaatctcaaaatcacacgtgggatacggttgtcgaagaaatcccgggctcaaaaggaaaagtctacaccgaaccgcgcccgccatacggtttccaacattttaccgtgacaagagaagacgccgagaaagaaaaacagaaagccgctgaaaaatgtcggagcctgaaagcctgatgggaaaactgacaacccatattttagatttaaccagcggcaaaccagcggcgaacgtaaaaattgaattgaagcggctgggcgaaagtattttgaaagaggtttacactaacaatgacggcagagtcaatgtccctctgctggctggtgaagagctggtttccggagagtatgtgatggaatttcatgcaggagactattttgcgaataaaaacgtgaatacggtcgaccagccgtttttaaccatagtcaccgtccgttttcagctagcagatccagatgcacattatcatatcccgctcttgctgtcgccgtttggttatcaggtgtatagggggagttaagaaggaagcccgcctcaccggcgggcttctatttgcacttcaataaacttttgatcctaggacagtacttgaagtgatccccacacttagtgaaacaacagctagaataaacattcacctatatttttcaggataattgcctacgagaaaaatatcctgtagtcctttcatttataaatcgaggtttcaaactaataagtcagctcttagcagccgagctcccttctccaatcctataaacagaccgcgttttttctcgaaaaaatactctgaagacaattgctgcgtttttaatagttttgataacgcgttctctcttacacctttagacaaaatattcattttttcttttttagacttaaatctatgtcgaaaatgatcgttggcatatcttatactatctccactaaaggaggtgacattatgggattctacaattctggtggatacagtggaaactctggttactcaaacggtttcgggagctccttcgctttgatcgtggtgctattcattttgttgatcattgttggagcagctatctttaattattaagtttaactttccttgcctccgccgtatccaacacctccctgtccgacagacgccataagaagtttttatggcgtctttgctatgtgttcactaatctttttctaatcagctttcaagttctacgagatttatcgtgtgttttcccacaacgcttctgcgtcttgatcgcgctgtctgactgaggctaaaaaagtccggcttttaaaagccggactcccgtctacccccgttcaactctcttctaatcctgcaagctgaccgcataatcccgccgtacccggtacaccggcacaaattccccgccagcccttcttctatatcttcgtcagaaggttgaggggtttcccgaaacagtgctttaagcgcaattatcattcctggggtacagtagccgcattggaagcctccttcttccagaaaagcggtttggcagatatccagttcctcttgttgtacgccctcgattgttgtaatggaatggccgtccacttgataagccatggtcatacacgcattggccagctttccgtcgattaaaatagagcaggctccgcagcggccgattccgcaggacacctttgtcccggtcagctgaaattcctttctaagcaggtcactcagatgtgtcgtaggaacggcagcaacctcccactcctgcccattcacggtcatccggaactgttccttttttacaggaaatggcccggcctcttttacgtccattgcttcagcccctttctgtctatcgcttcaagcagctcttctcttgaaatcggcagcttgtttatccagcatccgaccgcatcatgtactgcctttacaatcgccggagtgatggcgattgttccgatttcgccaacaccgcgcggtccatatacgtctcccttcattaagtcttctattgcaatcaccttcatgtcaggaacatctttgattccgggaatcaaatagtgatcgagattttccgcagcataacggccatccgtcattttcgcttcctccatcagtgtgtagccgagtgccatggcagcgccgccttcaatttgacctcgatatccctgcggactgatgaccggacctgccgcaatagcgtgctcacaatctatcaatttgacatcgcctgttaacagatctacctccacctcaacggcagccgctccaaatgagtagaggaaatggccgcccaccacaggatcaggcgttgttggaaagtcaaatgccgtttcctctgccaaagggcctttttcagccagctccttatacgtcaccacgagcgcctttgtgtttttgtcacgcaagcctgcagcgccgggaataagattttccgctgaacagccgctccattctgccgcccgttttttcaactgagctagaaacggcttcttcaaacgctggatcgcgtgccacaccatgcttgtgccgcgggatgctgtggaggagcctgacttcggcacttttgcggtatccccaataacaatggaaatatcctctgcggcacaacctaactcctccatgacaatctgttcaatcgctgctagaatcccctgtccgcattcttcaaatccaaacgaagcagtgattttgccttcactcgaaagagacaaacggcctcctgccgcatccattcggccataccccagcccgccgccgtgcattgtaattgccgctcccgtgcctctttgcagatacccgcagttccggctgcttcttgtaagaatgggagatttagatatggcattcaacacctgtgccgctccgtcagtcggtgcaatccgatgctcaagaggccccaagtcatgcggttttctgatattttttcttctcagctccagcgggtcgatgccgagcatgccgctgagacgatcgagatgggtttcgagtgcaaatgtgatttggttgccgccaaagccccgaaattcccccgccaccccgttgttcgtaaatactgatattccttcagtccggatattcggaatacggtacggccccgcggcatgctcgacagaaaaatctagaacggcaggcccaagcgtggcgtaagcgcctgtgtccgccacaattttcacgtcgtgcgccaatagatttcccgaatgatctgcacccgtttttatcgtaatcttcatcggatggcgcttaatgccagaacgtacagattcctttcgtgtctgatggattttgacagggcgtccgcttttcagggccaaaagcgcagcatacggctgaatattcagctcatccttccctccgaacgagccgcccatcggacttgacacaattctgatcttctcttcaggaatatcaaaaatacgggcaagctggaaacggtctttatagccgtgctgggttcctgcatacatcgtaaaacccccgtcgtcttccggaacggctacgcctccctccgtttccatatacgtatgcatctgccgcggcagctcataggtttcttcaaggactgtgtcagatgcttgaaacccttcttccacatcgccgtttgaaaaaaatgcgcggtggaggatattcccgtcctcatgcagtctttgcgcattcggccgaagcgctttttctggtgaatccatgacttccagctctttatactcaactcgaatcagctccagcgccgcttccgcgatttcttctgtttccgcagcaactgcggcgatcgcatccccgacataccgcaccctgtcctcacataaaaccggctgatcagggatgacaatgccaaatcggtttaagccgggaacgtctttatgtgtgacgacggcctgcacgccttccattttctcagcttttatggtgcaaaccgacacaatctctgcatgaggataagcacttctcagcaccttgccatacagcattcccggaaagctgagatcggtcatatatttcaattcccctgtgaccttatcccttccatccggcctgactcttgacggtttgttgatgatcatttattcccctccctcagccatcagctctgccatgatgacgttggcagcggctttttttctgtatgccgctgacataaaagcatctgaggaaaacggcagctcatggataagtgttttgtacagctcatgcgagtcccaccctggtgccatccatttcgcttcgctgtccaataatctcctaggagtgatatcggcatggccagcggcgaggcgaatgccgccgtctttcaaaaaacgtccagctgcaacagcaaccgctcctgtaaaagcctgacgccttccaagcttgtgataaaatacacgctctccctccgcccgcgggatgatgacacgcgtgacgatagccgttctaaagtcttcctcaatgagccaagcgccaagcggcagcctgattagcttcttttgatatacgataagatcagcatcaagcacaagcagaagcggaatgaaatcaccgattttactcgctatgttgccgccaatcgtggcacggctgcggattcccggtgcggcgacagcggaagcagcgtcactgaaacagccaagcgtgctcttgatcaaagggttctttctgcattcactcagtgatgtgagcgccccgatcgacacgtgggtgtcactggcgctgatccctcgcatctcgtcaatcccttcaaggctgacaaggtgctgtttcggtagagttcctttgtcccactgaagctgaagcagcgtgcttcccgatgcggcacacacatccggagcaagcttctctaaaagcgaataggcctcatcaagcgctgccggcctccataattgaatattcatccttgcttttgtcacttggccgttcaagccatcgccctccttaccatgtcatattcctcgggtgtatcaatatcgtccaactcgccgctatcctttgcctccaaaaccgctcctgctccaagctgtccgcttttcaggagcctgcgagccccttcatctcccgttaacccctttacataaggaaaacaagccgacgagaagtagattggcggggtgaacgcccctaaaaacgatgacacggcaaatggctcaggggccagtgccacaagggcattgagatgatcgacggaaagctgaggctggtcggctaacaaaatgacaacgccgtccgcccccatgctttctgcttttctcaccccgctgctgactgaatgcccctgacccttttctgcgtcttggcaaacgtgcaggctccagcgtttttgaaaaggcggagcgtgatacggcgctcctatccactcaagggaggcatgttctgtccgctcgacgaccagcacgtgatcaaggcgggacgacagagcagttttcaaggaaagtgagccgatgttttctccttttagcggcaaagccagcttgttttgacccattcttctgcttttgccggcagcgagaaacacgccgatcagataggggcttctcatacaaccgctattcgttttcttgtttgaatgatttctgcaactacacttaccgcaatttcctctggaccttccgcaccgattttcagcccgaccggactgtaaaagtgagacggaggatgttttccgttcagcagccgtttcgtgcggtttgccgaacccaacagtccaatataatggaggttttgagaaaataagaagttgatgatcgtttgatcgtgctgataatgatgggttgccacaacagctgcatcatgcggaaaaaattgaaatttgctaagcattcgttccggaaaagcggtgatcagctgatccgcttttggaaaaagagaggatgtacaataagcgggccgccaatccgtcacgataacagaaaaccctgtgtcagccgccaaattggccagcggtacagtatccggtcccgccccaaacagaatgaggcgcggcttcggttcaattcgctgaataaacatgttagtgggtggatcgaaatgcggtaaatgaagcgttgaaacagtacgttgaatatcttgcagaggcgcgtccggccagttgccaaaatgcccgttctccgtcagaaataaataatgggaggattcaatctttataacagaagtgacagctttgcctgaatgaaggcaatccctcactttctcatagtgccgccttttttcctgagtgattcgctctgcatgaacatgaataatgccattgcacccggctcccatgccccaagaaagatcgtcctccgaccgcatgtcgtagggaatcagcgttgatgtgagctgatcgcccagcgcactgattctttggaatacatcttcttccacacacccgccgctcagcaagccaatccgtctgccttttttcttaaagagcatagaggcgcctgcttttcgatacgcggagccttcaacttgaacaattgtcgccagtacagcctcctcctggtcttccaggagcgcatctaacatcgtgtgaaaattccccaatgccgcatcctcctctcgaaaattgccgtgagaaacaactagttcagcgtgattttataggtaacttgtataaagaatagacgatggaagaaaaaatgactcatgatttgtcagaaaatgaaacacatagaaagaggatttgtaaaaagagtcaaacgaagaaaatcagattggagaaaacacgaaatcatatctaaaaagcttgcggagttccgcaagcttttctttacaccgctgcctggcggccagcgttttcatacacatccagcgctgcttggagcgcttttcctgcttcgattcctgcgttatgtctgagaagcacagcctctaacccggcaagcacgaatagcacgttttcttttctgcagctgtaccccatcgtgccgattctccagatcttccctgcgagcgggccgaatgagctggcgatttcaataccgaattgtgccagcagcatgccacggacagactcgccgtcaatgccgccgggaatttcgacacaggtgacaacaggcattttgcagctgtcatctccaaacaatcttagccccattgcctttatccctgctgctaatgcggcttcatggtgccgatgccgctcaaaacgcgcctcaaggccttcttcaagcaccagtctgactccctcacgtaaggcgtacagcatcgtcgtcgcttctgtatgatgattgagccgtctttcgctccaataatcctcaagctggctcaaatcaaagtagttgcttgtgattggccgatttcccgaaagcgcttccctgtcagcttgtgacgcaatcccccgctccacctttttacgagctgcaatcacgtccgccacccgctcattatatgtaatcggcgccattcctgagggcacagacaaacacttttgcgttccgccgatggcagcatcaatcttccattcatcgactttaacctcgcagcccccaatcgttgcgactgcatcgacgataaacaatgcatcctcggtgcggcaggcttcgccgatggctttcagcgggtgaatccgtcctgtcgatgtttctccatgcaccatggccacaattttcggcttcactttttttatctcccgtatgatgtcctccgggtcaaaaaccgttccccattcgcactcaagcatatgaacatttgccccatatcgctcggcgatttcagtcagcaaataaccgaaacggccgtaaatgggaatgagcacatcatcttccggctctatgacactagccagcactgcttcaattcccgcccgtgaagtgccgtcaatcgggtatgcccagcggttttttgtttggaacagctcccgaagcatctccatcgtttcattcataatacctgtaaacgccggatcaaattggccgacaaccggggtgctcattactcttaatacacgcggatcaacctcaacaggccccggcgtcataatcgttcttaacggggtgcataattctcttctgcctgacacagccattcctcctttatcagtaagccagtttgtataataaatcagtcagtgcgcggacgccgatctcaagctgtctggctgacgtatattccttcggtgagtggctgacgccgcctcggctcggcacaaacagcatacaagcaggatagcgccttccgatcatttgcgcgtcatgccctgctccgctcaccatttcctcacagctgaagtcgttttctaatgctgtttcaaaagccgcagccttcagcctttcgtccatcggcacaggctctatccgcatatattcatcaatcacagcgcgaattcctttttgtaggcaaatgccgttgatcaaagcaatcatgtcttgatgaaactgttccagcacatgctgatgctgatggcgaatatcgattgaaaactggacgcggcccggtatgacattggctacattgggctctgccgttatttttccgcatgtcagacggagctcatccggcagctcctccgaccgcagtaacagctcatgaatgatacggctgctggctgcgagcgggtccttgcgccatttcatggaggtggttcccgcatgattgcattcaccctccagcgtgacgagatagcgcctctgccccgcaatgcttttcacaatcccgagatcccgtcctgacatttccaatgtctgtccctgttcaatatggagctcaacaaaagcgctgatatctgtccgatatgctgcctgaaacacacctttgccaaaaccgttctcatgcatcgcatgttgcagcgagactcctgattcgtctcttggctctgctccatcctgtaatgaaaaaacacccgtcatattccctgatccccaataggtcattggaaaacggctgccctcctcctcacataaggataccgcttcgagtgtttttttcggcgctccatatgtctctttgagccgctttatcgcaagcattgctgccagaacaccataggcgccgtcgtattttcccccattgatgacagtatcgatatgtgaaccggttataatgacttcatccggagactgggtgcccgaaagccttccaaacaaattgccgacatcgtcgaatcttgtgtcaagcccgaaagaagacatttccgttttcacagcaagctgtgcgtccatccactcttttgtgtataaaagcctcgttacgccgccatccgcagacgcaccgtattgggcgagccattcaatataatctgtgatgctgttttttactgaaagcttctgcttttccatgtactcccccctctggccgctatggtgacttcattatagaaggaggaacatgatagttcattgacagattaaccaaaaaaacgtttattttttagtcacagtatctatccagcaaccagattcaccctacatgtcacaactattttgatgtaaaggtcaaaaggaaacacggtaaggaagagagccagcaagagcgaaagagagggtcaagctcagcttgccagagaggcgatgtttgcggaacggatgaaaacggaaatgccggcagctcgcaaaaacaggacctaaagatatgggaacaggagatttccgcctcctccaaagggactaatttacaattttaatgaaaaatatacaaaatgacacttctatcctttatttcaattttagataatagacatgatctgataaaaggagggcaagtgatgacaaaaaaatcatggtttctgccgctcgtctgtgtattactgatttccggatggcttgcgccggcagcttcagcaagcgcgcaaaccgaattaagcctcaatgaccgattggcgtcttcccctgcaggaacaggaagccttctctcattagccgcccccgctgcaccctatgctgacacagatacctattatgaaggggctgaaggtaaaacaggagactcgctaaaaagcaccctgcaccgtattattagcggacacacgatgctatcctacagcgaagtgtggaacgcgctgaaagaaacggatgaagatccgagaaatccgaataacgtcatcctgctctatacgaatgaatcgcggtccaaaaacctgaacggcggcaatgtcggcgattggaaccgcgagcatgtctgggcgaaatcccatggcgattttggtacgagcaagggacctggtactgatattcatcatttgcgcccggctgatgttcaagttaacagcgcaagaggaaatatggattttgacaatggcggcactgaatatgcgaaggcacccggaaattattatgacggcgattcatgggagccccgcgatgatgtgaaaggcgatgttgcccgcatgctgttttacatggctgtccgttacgagggtgatgacggctatcctgatcttgagcttaatgataagacaggcaacggctcagctccttatcatggcaaacaatctgtcctgctcgaatggaataagcaggatccggttgacgaccgcgagcggaaaagaaatgaaatcatttatgaaaaatatcagcacaaccgcaatccatttatcgaccaccctgaatgggcggatgagatttggccgtaagaaaaaggtgctccttttgaggagcacctttttctaatacacagcctcttccgtttccgcatcgaaaaagacgacgtggtccattttcactgagagctggattgaatcgcctgcatcgattcgcgtgtttccgtccaggcggaccttgagccgctcgtccccagccatgacatgtactatgagctccgagcccagattttcattcacttccacgttcgcttgaaacactgaatcaaacaactggtcatttcctgtcatttgtgtgatgtgctccggccgtacaccggcaatcatctgttctccggcatatcccttttccttcagccgctttgctttttcttcaggaatatgaagccggatcgaagaatttgtgaaaaacagctcgccatgctgctgttctatgatgcctttcaaaaagttcattccgggagagccaatgaagcctgcgacaaacaaattggccgggtaatgataaatgtcatgaggtttcgccacttgctgaatttccccttcattcatgacgacaatccgatctcccattgtcattgcttcggtctggtcatgcgtgacataaatgatcgttgcctctaatcgctggtgcagcttgctgatttctgtccgcatcgtcactcttagttttgcatccagattagaaagcggctcgtccattaaaaagaccttcggctccctcacaatcgacctgccaagcgccaccctttgccgctgcccgccggagagcgccttcggttttctcttcagcaaatgttcaatttctaaaattctggctgccgcatgaacccgctcggcaatttcctgtttcgccatctttctgagctttaatccaaacgccatattatcaaaaaccgtcatatgcggataaagcgcatagttttggaataccatcgcaatatcacgttctttcggcggaagatcattgacccgctccccatcaataagaagatttccttcagaaatgctttctaatccagccaccatccgcagcgttgttgattttccgcatcctgacggccccaccagcaccaaaagctccttatcctttacatctaaatcaaagtccttcacggttaattgtgagtgatatgattttttgacgtgttcaaatgttaatgaagccatcagaaaagtccccctatcttttgacccgttatttcgtcactggaaacaacttggtctttctgttatttttagagtaatcgattcccatttttgctatatttctaaaataaaaaatgtaaatttgtattataacgtcataatacattataatataaataataggttaaaaggaggctaccctttgttaaacaacggaagttctacacctttatacattcagctaaaacaaatcatcactgatgacatcaaaaagggcgtgtattccccaactgccaagctgcctaccgaaaacgagctttgcaccaagtataacgtcagccgcatcaccgtcaggaaagccattctcgatttagtcgaagaaggctatctgatcaggcagcagggaaagggaacgttcgttaaaagccctaaattaaaacgagagctgatcgctgtaaacggctactcggaatttatggaatcaaccggcaaaaaaccgaagcatcatgtgctgtcccatgacatcattccagcgtcaaaacccatcgccgaaaagcttcaaatccaacccgagagccctgtggttgaattaaaacggattttatataatgatgatcagcctctcacctttgaagtgacgcattatccgcttgatttgtttcccggcattgatacctttattgctgacggcgtatccatgcatgatattttgaaacagcaatacaaagttgtacccacgcacaatacgaagctattaaacgttgtatatgcccaacaggaggaaagcaaatacctggattgtgatatcggggatgcgctgtttgaaattgataaaacggcttttacatcaaacgaccagccaatctattgctcattgtttttgatgcacacaaaccgtgtcacttttaccatcaacagcccctacacataacaggcataaaaaacgagacactgcttatagtattctcgttttttcactgcttcccccgtcctccaagcgataaggatagccatagccgaaagctccgtacacaccgcatgttttcgcagccgtttcggcggcctggcgcaaagcgtacgttatatcctgcttcacgcaaaaggcagtcaaaaagcctgctataaaagaatctcccgctccaagtgtatctattatatcagcttccacaatcggctgatgatagactcgatcacccgcagacaggattgctccttggccccctcgggtcatacaaaccattttggctccgtacccatgagctgttttggcaagctcaccgcattccgactcactcaaatcgcttcctgaaaaaaacgcatacgtcacataaggacagaccctcctcaaataatcatcctcccgattggttgaaaaatcaaatgagacagggaccagcccgcacagctgcggaagatcgttctcaagcctgctgtacacgctcgtatgcagcagatcatgcccgctgataaaagatacatctttctcctgaaacgcgaggcgaagccgggactgaatgccgcctttatttgatctgacaaaaatgcggtccccctgttcatcaagggtgacaatcgccatcccgttttctccgtgcgcctggcggatataatctgcattgacctgctccagcttgagaacgttcaacagatgcgccgcggcttcgtcattgccgacgattccaatataggaagactcatgcccgagccgcttggcaagcacagcaacgtttaaggcatttcctcccgggtaaaatgtttcttgatcctggtagtaatctacaacattatctccaaccgcaatcaatttcatagcgcttcctcctttatccttttacactgccgcttgcaatcccgcggacaaaatatttctgcatcaataaaaatagaataataatcggcgcggctgaaatcgttaaccccgccagcaggacgccccagtctgtctgcagcgcgtctctgaactgcatcagcccggctggaatggtccgtaaattctcatcatctatgaaaataatcgcaaacataaactcattccatgtatggtaagccgtcaaaatgccggatgtcaccaaaatcggcacgctcattggtaagaaaattctgaaaaatactccaaaacttgtacacccatccaaataggccgcctcctccaattcttttgaaatagaaagaaaataagagcggatcaaaatgatggtgaatgggatccgataagccgcatacggcaggattaacgcccaatacgtattgtacaggccaagcgactgaataatagaataaagcggcacaagactgacctgcggcgtcagcatcaatccgccgagacatagcaccaagaagaatccttttcctttaaactcaaaccgggaaaggccatacgctgcccatgcactgataaagacagtgatcacacacgtcagcgccgtaacgatgacactgttcataaaataagaagaaatcccctggttccaggcggaaacaaaattttccggatgccacgatgacggcagcgaccagctgtgctcaaaaatatcgtcagagtttttaaaggcgctcatcaccatccagagaagcggataggcaatcgcaatcagataaagaaacagaaaaacccacacagacgtttctccgatataccattttcgtctaggcttatctttaacctcaatgtgctggtcaggcacaggctccaacctgaacgaatctgtcttcttctgaggcagcatcagttactcctcctttccggttttaaagaacttcatttgcatgagcgataatgcaagcgtaatgattaacacgacagtggcaatcgctgaggcgtagcccatcatatcctttgtaaaggcgcttttatataaaaacgtgctcaagacttctgacgcgtttcccggcccgccgcctgtcaaaatgtacggctcattaaagaccgtaaaggccccggtcagcgtcatgaccaccgcaacaaaagacatctctttcgtctggggaacagtaatatgaaaaaactgctgaattttacccgcgccgtcaagccgggccgcttcatacagttcatccggtattttttgaatcgacacaatgtacagcatcgcaatataaccgacagattgccactgggacacaaaaatgacagaaagcatagctgtgctgtcatccccgagccaggccctcgtcagctgatcaagaccgatggcctgaagcagctgattcaaaagccctgtctccggattgtaaataaaatcaaacaaaagcgcgatcacagtcattgagatgacaaccggcaaaaagaaaacggtacgaaaaaacggcgaccattttctgaccagcttatcctcaagcaccgccgccaaaatcaaaccgccaaatacctggcatacaattgagatcactgcataaagcacattattggtaagtgcctgatagaagacaggatcatgaaataattcaacatagttttttaagccgataaacgttttttccggagaaaatgagctccactgaaacaggctgaggaatacattctcaaaaatcgggatataaacgaaaagtaaaaaaacgagagcgggcaccaaaaacaaataggggattattttattctgattgaccaagggtatctcatctcctttataaaaagaaaaggtgcgaagcttcaccttttctttgatttattcagctgacgccctcacctgctttgctgccttttgaacggctttcatcacctgctgcggtgtcatgtcgccgccaagcatttgctggacgccagttaggtacgcatctgcgacttcaacatcgacatccatatcaaaccatggaaccattgatttggcatcaacaatatgctgaacggcttcacgctgaatggctgttgcattttcttcagtagccgtaccttgcactgcactgtatttcccgacatctttcacgagcttttcgcccattcttttcgacgtcaagaactgcaaaaattccatcgcttccttcggatgttttgttcttgaggaaatcatgaatccttccggcgctcccgttaacgcttctgaagatcctttctgcccgctaatttcaggaaatgggaacatcccgagattaaccggttcaaccagcttgatttccgctgtttccgcatatatcatcgccgactttccgctcttaaattgctgtctcacatattcgtggtcgacggagtttacatgtttattaaagtaaggcatcagctcttgaagcttttcaagtgcttttacgtagccttcatcagtaaattcacccgttttggcgttatagtccttttcccgtgttttttcatcgaccatccgctgattaagcgtgccgatatagtgcgagattgtccaagtcgcctttgttccgaagctgatcggtgtgtagccatgttctttcagcttttttgacacatcgattaattcatcccacgtcttcggggatcaagattcagcttttggaaaatgtctttattatagaagaatgatttagcgtccatttgccacggcacgccatattgcttgttttcataagtaaatggtgtaatttgcgattgaacgagctgtgatgaccaatcggtgtcatttttgtagtaggacgagagatcaagtgctttattgcctctgataaatttaaaagcaaactcatcgctccaagagaagtaaatgtcaggagggctggtggttcccagcatgaccttaattttatctttataggagtcatttaaaacggcttcaatttgtatatcgatatctgggtgttctttttcaaattccttaacaacctcttcaaaataacttttttccggctccttcggccatctgtggaaaaatttcaatgtcacctttccgtccgctgaactgctttggctcgaacagcctgcaatggtgaacatactgacagctgcaatgatcaagaacaacaacattttcttcaaagggttggcctcctctggacattagactataatgttatataacattatagtctaatgcataatggttcctcattttcagatcaatactcaactttccacatgtatcttctatgagataaaggatgatttctcgcctctgccagctcgtctgcatagcttctcagcacacgattgagaacgagcggagcaagatagcctttaactgaatcgtcaattgcagtgaagtcgtaagatgcagcatcaagcacagtgagctttttgccatactttttcgagaaggtaagcgctcgctcttcaagaggtcttgtttcatctaaaccgagcaggatgataaacggcacggattcatcaataatttcaaacggtccgtgaaaatattctccggcatgaatggcgtgggaatgaatccattgcatttccatgagaatgcagatgctgtaggagtaagcgacaccgtagtttgcaccgcttgccatggtataaataatactttctttttcatgggcttttgcaaattgcttggcgttgtcagcttcctgcttaagggctttttcatatacagcctgcaattgatctaagccttcaattgcttgttggaatttcgtattgttttctaatacttgcagggttccaaaaacgatttgatacaaaacgccatagtttgtattgatcgcaagcgcctcatcaccccaatcgtactgggcaacatattgcgcttcctgcgctaaaggagactccggtttaaacgtcatcgcaatcgtaagtgcgcccttgccccttgcaaacgcagcagctttgactgtctccggggtatttcccgaatgcgagcacaaaataacaagagacttttcaccaagctgaacagggttgcgctgaataaattcgttggcgctgtagaggtcggagtttattgattttgactctctgtcaaacacatacttactcggatacataatggcagaagaccctccgcatgcgacaaagaatacatgatcaatggttttccctttcaaatcctgcaagaaagcttgaacctcacgatttacttttgctgtggcctgactcaaatccttcactccccgtttttattatataacgttatataacattatatattgttatattaaagtccgcgggtaggattgtcaatattattttctgaaatttctcaataatttattcgaatgacagacaaagggtcaataagcgaaaaaatgcccaaatcaaaagccagaacttgacttaagctctggcttcgctgttcaatccgcagactgacgtcttatttaaaaaataccttgtctatattgtacttcgagtgctgtgtattgatgatatatgtttcataaatctctctttccattggatcatcaactacacatacctcaattttataaacttcatctctgtgatgtttgatcggtgaaacagtgtcttcgaaatgcttcttaattctctgtcttaactttctggctttaccgacaaacagcagctcgtcatgaatgttgtaaaacataaaaatgccgcctttgtcccttgggatctggtgaaagtcgatgaatccgtgaatcggttttatcttcggctcgttatcattagctgactgctgtcgttcagtgatggtgacattcggtgcgggtatatcaatttttatcaaaatcagttcacgtcctctttttcattaaagataaatgctaacacatacagaaaagaaaagctagaacagctttattatatttgtttgttatgctcttgcttattatgcaagtgctccggctggatgataaggactaaggtctaattctgtctgctttccgagaactagctttgcgagctctgcacccaagaacggtcccatcgtcagtccagaagcacccaaaccgtttgcagcatataggccttgaacattcggcacggcccctacgaccggcagaaaacccggtgtaaacggcctgaagcccactcttgtttcaactgcagcggcatcagcaagacccggtgcaacggctaacgctttgctcaatacttcgtgcaggcctccggctgtcacacgaagatcatcaaggcctgcatcgttttcgtgtgtggcgccggctacaattctgccgttatcaaacgaaagaatgtactgatcactcggcggcattacaaccggccacgatcctgtatctgtatctgtcatttcaaaatgcataatctgcgctttttgaaatgacacttgaaaatgaatgccaagagacttcaatatctcattggcccatgctcccgccgtcacaatgaccgcgtcagccgcaaactgctttgcatctgtttgcacgccgttgactgttccgttttcaaaaagcaaagacgcatttcctttgatgaccgttgcgccgcgtttctctgcagcgcttaaaagcgaccggcacagcgctcttccgttcacacgggcggcaccgctgatatgaaccgattcatagccgtcagctaaaatcggaaacagctttttcgtttcacttgcagacaagcgggtaatgtcgccgatttccggcgcatcctcccgtctcttatacgccctttcctccattttatcgagtttagacgcgtccgtatgaatgctgatggcaccgacacgtttgtatcctgtatccgtttcaccgtctttttccaattgatggattaaatccttatagtaccgggctccccccttagcaagctggtaccaatcctgattacggcgttgcgagagccatggacagacgatccccgccgccgcatcagtcgcttgtcccggctctttccgatcaatgacagtaacgcgagcgcctgattttgcgagatgataagccgtcgacgcgcccagaatccctgcgccgacgatgatgtacgatttcatatgcaaacaccttttctattataatgtctattcattttaccaaatcgaatgctttccttcgaccttttgccctaatgtggaaaaaccgcgaagttcgtccaatctctttactctcctatcgaatatcctgtcactatcaatagagaaaggatgataccatgagcgaaaatcgtcatgaaaatgaagaaaacagacgcgatgcggcagtcgcaaaagtccaaaacagcggtaatgcaaaagtcgtggtcagcgtgaatacagatcaggatcaggatcaggcacaggcgcagtcacaagacggagaagactaatgaacgaaaacatcattcctctcaacagacatactcaagagatacccactactgaatctgttatcaaaaacagcggcaactcagaggtccatatcgacattcacattgatacaatgccaattgcttttgctatattatgctctgcattagccgcaaagcagatgacaaaagaggaattcgatatggcttatactcaattgcgagagatgaacagagaaaataacagcagatcatctgtaaagcaaattatcaatcaggagacagaagaagagtaaaaaaccgcggcccctcggccagcggtttttcttctgcatacaaaaaggacgcgactgaaaaccagtcgcgtcctttttataaaaaaataatcgattgaaccttccatttcgaacttgattatttttataaaatggtacggaatgatttataaaagggtcacccaaacccttgatttaaagccatttcttcagatggtttaaatgatgataatcttaacttggcaccgtgttggcatgagctgaagccgcatgatataagggtttacagtaataattcacggttgccgccgtgagtaagtttcatatcttttgaaagttattattgaagtaatgcacctgttagttgaactattccacggcttatttaaactgtactaatcttttgaaatagaaataccgttctcaataaaatgctttattcatatttaaatttttgaggctactaggcatacatccaaaccaagttttgaccctgagcgtaaactagttaaaagtctaattgcaataaggagtgaacctcgaataatggtatatcaaagacaaatgacaccctatgccctgaatccccgggatttacaaaattgtttgtatcgtttcacgtatttgtggcttagaaataatgataatttctggtatttcttaacggctatcggagaatcaagagtttatggatataggtttttcggtggaagatggaataattattccgttgatttaagagatattgtttccttctattgttctcctccgactccaactctatattaaaacactgagcctgatatttgcatatgaagaaaatatttgtgaattaaaaaaggtcaaagcaaaatgaattgaatcttgaaatatccaggattcaaaaaaacaaagatgtaatcattttctaaaattacaataggcactatcttacacattcgaaactatcacaagcttcaggggttgaatatagaggcttacacgctttcagacacggttggacactagaacactaaaacaataagtgaaaaatattcacacataactgaaaaaatcgaacaagatgagcttgcaaaatttgcttcttactcaacaagataacaaaaagcttggcataaaaattggcacaatagaaacttggcatatgtcgaaaataagaaaaacccttgataaacaagggtttttcgttagttatccaatagaaccttccatttcgaacttaatcaaacggttcatttcaactgcgtattccattggaagctcttttgtgaatggctcgatgaagcccattacgatcatttcagttgcttcttcttcagaaataccgcggctcatcaagtagaagagctgctcttcagatactttagacactttcgcttcgtgctccaatgaaatgttatcatttaagatttcattgtaaggaattgtgtctgaagttgatttgttatccataatgagcgtatcgcactcgatgttagagcgggcgccttccgctttgcgtccgaagtggacgattccgcggtacgttacttttccgccctgttttgaaatcgattttgatacgattgtagatgatgtgtttggtgcaaggtgaatcattttcgcacctgcatcctgatgctggcctttacccgcaagagcgatagaaagcgtcataccgcgcgcgccttcgccttttaggatacaagccggatatttcattgtcagcttagaaccgatgttgccgtcgatccattccattgttgcgttttcttcacagactgtacgctttgttacaaggttgtaaacgttgttcgcccagttttggatcgttgtataacggcagtagccgccttttttcacgatgatctcaacgaccgcactgtgaagtgagtttgttgtgtaaacaggcgcagtacagccttcaacataatgaacgcttgcttcttcgtcaacaatgatcagtgtacgttcgaactgacccatgttctcagagttgatacggaagtaagcttgtagcggtgtttcaaccttcacgcctttaggcacgtagatgaaagaaccgccggaccaaacagctgagttaagcgccgcaaacttgttatcagtcggcgggattacttttgcccagtgctcacggaaaatatcttcattctctttcagcgcgctgtcagtgtctttaaagacgatgccttgtgcttcaagatcttctttcatgttgtggtatacaacctcagattcgtactgagcagaaacacccgcaaggtatttttgttcagcttcaggaataccgagcttgtcgaatgtttgtttaatttcttcaggaacttcatcccaagaacgctctgaacgctcagacggttttacgtagtacgtaatttcgtcaaagttcagtgagtttaaatctccgccccattgaggcatcggcatattgtagaaatgctcaagtgatttcaagcggaagtcaagcatccattgaggctcttctttcatgcgagaaatttcttctacgatttcttttgtcaatccgcgctctgaacggaaaatggaaacgtccttgtcgtgaaaaccatacttgtattcaccaatatcaggcatttttttagccatccattttcactccaatccttttaattgccgccttcttctttcgcgactcctttttcaagtgctttccatgacagggttgcacatttgatacgggcagggaattttgaaacgccttgaagggcttcaatatccccgagatctatagaatcatcatactctttcccttgcatcatatccgagaaaatcttagacatggaaagggcagtttcaatatctttccctttaatcgcctgagtcatcatcgaagcggatgccattgaaatggaacagccttccccttcaaacttcgcatcttccacgatgtctccgtcaagcttcattgtcagtctgatgcggtcgccgcatgtcggattgttcatatccacgacaatgctgtcattcaaaacccctttatttcgcgggtttttgtaatgatccataatcacctgtctgtacaatgtatctaagtttgcattaaaagacatttgtaaaatactcctttgtcttttgaagagcttccacaagcttatcaatctcttcctctgtattatacagataaaagcttgctcttgcagtagcagttacatccagccatttcatcagcggctgcgcacaatggtggccggctctgactgcgattccctccgcatcaagcacagtcgccacatcgtgcggatgaacatcatcaaggttaaatgtgacaagcccggcacgctcttccggcccgtaaaccgttacgccgtcaagctggcggaagcgttcaagcgcataagctgcaagcttgtgctcatggcgggaaatctcatcaagaccgatttcttcgagaaaatcaatggcggcaccgaggccgattgctcctgcaataatcggagtacccgcttcgaatttccacggaagctctttccaagttgattcataaagcccgacaaagtcgatcatttcaccgccgaattcggcaggctccatgttttccagcagggctttctttccgtacagcacaccaacaccagtaggtccgcacattttatgggaagaaagcgcaaagaagtcgcaatcgagatcctgcacgtcaattttcatgtgaggcgtgctttgtgcaccgtccaccacaatgacagccccattgtcatgagcgattttcgccatttctttaatcgggttgaccgtgccgagaacattagatacatgagacaccgcaacaatttttgtgttgcttgtgaccgtttctctgacgtcttctaaagaaatcgttccgtcttcctgcagcggaatatattttaatgtggcgccagttgcttttacagcctgctgccacggaatgatattcgcatgatgctccatgtaggtgatgaccacttcatcaccaggtttcaggttggcgcgcgcatagcttaacgccaccatattcagtgatgtggtcgtgccttttgtgaaaataatctcagccattgacttcgcgttaataaactttcggactttttcacgcgctccttcataaccatctgtcgctctggttccaagtgtatggacgccccggtgaacattggaattgtattggttataatacttatccagtgtttcaatgacagcacgcggcttctgggaagtcgccgcgctgtcgagataaacgagatcatgtccgttcacttgctgatgaaggatcgggaactgttcacgaatatctgtgatattcattacttcactttcctttcgataacagaaactaattgtttcttaacgccttcaatcggaagttcatttactaccggtgcaaggaatccgtaaatgactaagcgttctgcttcttctttcggaattccgcggctcatcaggtagtaaagctgaatagggtccacacggccgacagatgccgcatgtcctgcagttacatcgtcttcgtcaattaaaagaatagggtttgcgtctccgcgtgctttttcgctgagcatcagcacgcgtgattcttgctccgcattcgctttagaagcgccatgttcgattttgccgattccgttaaagatagaagaagcggaatccttcatcacaccgtgcttcaagatatagccttcagaagctttaccgaagtggatgatttgtgttgtgaagttttctgtttgctctcctcttccgacaacaaccgttttcgtatcgccgtatgtgccgtcaccgtaaaggtttgttgtattttcggaaatcgtgtcgccgtcgttcatcaggccaagagcccactcgattttgctgtcgcgtccgcgcgcagcaccgcggcggttcacataagttgtcacaccgcttgacagattatccaccgcaccgtatgtcacgctggcattatcacctgtgatgacctcactgataatattgaagacagcgtctttcgggtttacagtgctgatgtagttttctacatatgttacagagctgtggtcttcagccacaatcagcacgtggttgaatagagctgtatcattgctttcgtggacataaacagcctgaaccggcgtctccacctgaacatttttcggaacataaaggaatgctcctccgttaacaagagccgcgtgaagtgcagttaacttatgttcgtcaaccttcacgccgtccttcataaagtatttctccaccaagtcgctgtgctcgcgtgcagcagtcagaatatcagtgaagatgacgcctttgtctttcaattcttgagaaagagaaagatgtgccggcgtctggtcacgctgtacgtataatgttttatcttcgttttcaatgtcgatcagcgcttttacttcatcagtcaaatcttctaatgaagaaagcggttcgttatccactgtatgcttcgcgaaattcgtgaagttccagtttgtgatttttgttttgtcaggtttcggcatcggcagatcctcagcttgttcaagagcctgtaagcgcaggttcttcagccaggcaggttcttggtgcttttcggaaaagcttttgagatactcctgatctacggatagttttgtacctagtgtcatattaatccccctaacgcttacgcttcttggccaacagtttcgtcttcaatgccaagttcttgtttgatccagtcataaccttctgcttcaagacgctgtgcaagctctgcaccgccggattttacaacgcggccttgcatcataacgtgaacaacatccggagtgatgtagtttaacaggcgctgatagtgagtgatcatcaggcagccgaagttttcgctgcgcattttgttgatcccttttgatacaactttcaaagcgtcaatatcaagacctgagtcaatttcatcaaggatggcgattttcggttcaatcatcattaattgaaggatttcgttgcgttttttctccccgcctgagaagccttcgttaagatagcgctgagccatttcagggtccatttcaaggaactccatgttttcgtccattttgcggatgaatttcatgagagaaatttcatcgccttcttctctgcgcgcgttgattgctgagcgaaggaagtcggcatttgtcacaccgctgatttcacttgggtactgcatcgcaaggaataagcctgcctgcgcacgctcgtccacttccatctccagtacatctttgccgtcaagcgtgatgctgccttttgttacttcatatttaggatgccccataatagcagctgataaagtggatttaccagttccgttcgggcccattactgcgtggaattctccaccttttatttcaaggtttacaccctttaagatctctttcccttcgatttcaacgtgaagatctttgatcgttaatgttgaagcagccatatctatacctccaaaaatatataatcattattctcattttattctcattctaattttataacaaatgaaaagtaaatacaactttttatcgtgccttgcacattcctcaagtttaacaaagatcagcactttattaaagcgattgaaaaagaaaaagagtggattcccacccttttttaaaagattgattttctcaataagctcccgcagaaatccgcttgcttttttcgtaatcaagctctctctgccgctctactttcattcttgtttccagccggcgtccatattcctcgtatccaattccgtgtgacagctgcatcgctttttccatttctgacgtataatcgaggttcagtctgtcctggctactgcaaataatgaatcaatcccttcatatatttgctttttattgtaccagtgctgcgttggatgccgcaaaaacgatttggcgtgaaatagcggcagatgagacgaaagcatcctttcagaacaaatgagaatggtttttcggaatattccttctcttaatgcgtggtgtttccgaattcctcaatgcactgttgaacgactgtcacgccttggctgaaagctgcgccgcctccaaatgccgctgccacactgacggcttcgagaatgttttcttctgtcgctccctgatcgagacagccttttgtatgatagatcatgcaatattcgtcctgagcattgatggcaattccgagggcgatcagctgtttttctctttcagtcagagaattcccggcaaagcactgttcagtaaattcgttaaattttcttcccatcagcggcatcttttgttcaaatgtgcctaaaccatgtttatattgttttaacgcgtcctgcatgcttcctctgtcttgattcaaagaaaatccctccatctgtttaacattcctttttattatgaacagcttttaggaaaatacgcgaaaaaaccccggaattctcatccggggtttcagtcttattcagatacaggaagcacagctccgtcgtattttttctcgatgaagtctttgatctttttagagtgaagaacttccatcagcgctttgatttttgcagaatcttcttcgccttttcttactgcgatgatgttagcgtatgggttgtttttcgttgattctacttcaattgcgtcttttttaggatttaatttattttggatcgcatagtttacattgatgaagaccgcgtctccttctttgttttcatatgcttttgccgttaattcaggcgctactttttcgaattcaagatttttcgggtttttcttaatgtctttcaatgttgcgtcaactgtttccactttagaatcaagagtgattaatccagcgttttcaagcattgcaagcatacgtccttgttcagcaacgttgtttgtcagaatgattgtcgcaccgtctggaaggtctttcagtgatttgtatgttttagagtaaataccgaatggctctaagtgaacagcgccggcattcacaagtttgtaatctgtgttttctttcatttcttgctcaaggtaaggaatgtgctggaagtagttcgcgtccacttctttatcagctaaagctttattgtacattttgtaatcactaagcactttcactttcagcgtatagcctttttctttcagcaatggttcagcttcttttaaaatttctgcatgcggtgttttcgttgccgcaacgacaatttctttcttgccggattcagcgccgttattcgaaccgcaggcagccataactcctgcaaatacaagcagtaatgcacccaaaaatagctttttcaatgtaaatcctcccttatcgtttgtctataatatttgttattagatcaccgatgatttgaataataaacacgatgattaaaataaacacagtagcaacgaaggtaacatcagcgttattagactgatatccttctacgtacgcaaggtttccaaggcctcctgaaccaatggctccggcaattgccgttgagccgatcaaagcgatggctgtaaccgtaatgccagaaataagagcaggcattgattccggaatcagcactttgaaaataatcgtagacgttttcgcgcccattgatttagctgcttcaatcacacctttatccacctcacgcaacgcgatttcaacaaggcgcgcgtaaaatggtgccgagccgattaccagcgccggcaatgcggcgtttggccctaagatcgtgccgactaaaaatttcgtaaaacctaatagtaaaataattaaaataaggaacggaatcgatctgaatatgttaacaacggccgcaatcactgagttgaccgctttattctgccagaggcttcctttgctcgtcagaaagagcagcaagccgaggatgaccccgatgacaaaagcaaacagtaaagaaatcagcgtcatataaagtgtttcatatgtcgcgttccataattcagttaaatcaacgttcgggaagtatttttcaaacattcgtgatcacctctgctttcacctgtttgtcattaatgaaacggatcacgttttgcacttcttcctcgtccccgtcaatgtggatgaacagtgaaccgtaagccccatccttcgtctgcgaaattttcccttgcagaatattgacgctgacattgaagtttctgatcatctctgtaatcagaggctgttcagctgactcaccgacaaatgtgagctgaaccatttttcctgatgctgtatcatcaagaaggtgctgaagcgtctctttcgtttcttccggctctgtcacctgctgaacaaatcgttttgtcatttgttcctttggatttttaaagacatcgagaacctcgccttcttcgaccaccttgccgttttccatgacggcgactctgttgcagattttgcggatgacatgcatttcgtgcgtaatcagcacaatcgtcaaaccgagtctttcattaatatcggacaatagatccagaattgaatctgtcgtttgcggatctaatgctgatgtcgcttcgtcacaaaggagaaccttcggattgtttgcaagcgctctggcaattccgacacgctgcttctgaccgccgctcagctgggacggatatgatttttcttttccttctaaacctaccagtttaatcagttcattggcgcgcttgatccgctcgctctttttcaccccggcaatttctaaaggaaacatgatattatctctgacagtccgcgaccaaagcaaattgaaatgctggaaaatcatactgatctcatggcgtgcttttcttaaaccgcgtccatttacttcattaattttggttcccgccacttccacggttcctgaggttggtttctcaaggccgttcagcagacggattaaggaactcttaccagctccgctatatcctataattccaaaaatctcaccttttttaatggaaagcgagacattttggacagcattgacatctccatgtttcgacttgtaaacttttgaaacatcctgaagattgatcaaagcaatcacctgccttaacactattctaagaaatcttccggttttttctgcaaaagaaaagcctttctgcacacttgagcagaaaggcttatataaaatgcctttctctcatctttcaaagctgaacgcttcgtgtgaattggcaccatttcaacagtgttgatggttgccgggcttcatagggcacttccctccacctctcttgataagagaaatatatagtctttttcgtccggaaattcttaatgtagaatagcacggcgaatgattaaatgtcaataaaataaatgatgtcaacttttactattataataatttattattttttaattttttaaaatcctctgaaaaaatccatttgtcagccagagaatggcttccagctttaacagggccctgaatgacccctttactttgaggcttccgctctgaatcaggtgctgaagggaaatgtctccgtgcaataaatcaataatttccgtttggtttccgtaaaaggtcaggttggacgtttggggcggagaaacttttttcatttctccctgttcgtttattgagacggttaaggcttctgcttctccttggaaggtaatgagcaatgttgaggcattcaaaaggggttttaaaaacagatgctgatactcatcctctaaaacttccgctttctccatatgtacaacctcctatttgttggtcatacatacacatttctctctttgtcgcaagaacccctttataaaacgaacgacaatttcataggatatgctgagaaatatgtcataaatgggatgcggaagatgatttttgtttgatcagctcatataaataagaaacggaatgaaatgcatatcctctttcgaccatctttccgcctttaaacagcagaaaacaagggacgctttcaatttgatacgcttttgcgaatgtcggagagtaattgacattgttttgatagaaggcgacatccggcagcatttctttcaccactgtcagcattttgcttgcaagctggcaggtgccgcaaaacggagtatataaatatagaaggtacacatcatcttcaatgtgatcaagttcgtgttcttggagttctttcatgctatacacctcgggactttctttcaagaaaaatagtatggacattcagattcgcacgcagtaatacagaagcgacatggtgcctgggagcagccgctacttccttataggctctgtcgatatggagatggcaggcttcattaaattcacgcttcagctgttttctcaatttctcacctgattcatcagcatcaactaatatatagacgtctttatcataaagctcgtcagccaattcctcgagcctcagctggctgattgttccgtttgtgcagataatgcgcaccggttcattcaggacgctttcgattttctctttatctgatttcccctcgacaatcataaccttttccagctcatccatcttcatcttgttcacctgccgcgtcaaatttgaaacgttcagattgtaaaagaaggcagtgaaattcaccgccaacattaacaccagccgttttcgtagtcacaatctacatattttgcgtcgtctccagagaccacatcggctgtcttataaaatttctcattttcaaaggaataaccggacttaagctcatattcattcatgcttgtcatttggccgatcatctcattatcatgatataacgagagccggccattttgaaagcggcctgtcacgtcattggtgacatcgagcttttgtttgtcgaaagccatattggacacctcccataacgttagcgtgtccaattgcttttacggctatcctgttttagtcttcttgtgtcatctcttcgtattgctctgctgtcatcagtttttcaatttcagaagcgtcagatggctcaacgacgatcatccatgctttttcgtacggagattcgttgacgaattccggactgtcatcaagatcttcgtttacttccacaaccgttccgttaatcggtgcataaagctcagataccgttttaacggattcaacactgccgaatggctcgtccgctttgatttcagcgcccacttcaggaagttcgacaaacacgatgtcgcctagttcggactgggcaaaatgcgtaattccgattctggctttttctccttcaacttttacccactcgtgttctcctgagtaacgcaaatcttttggtatgctcaattgaatccctccattttttacagcactacaataagaagataccacacttttcaaaaaaaatttacattaagcccagttttcttcaaattggtcttctttaaatccgacagtcactttttcaccgtctgttgtaagcgggcgtttgatcagcataccatctgaagccagcagctcgagctgttcgtcctctgacatgtgatacagcttttccttgagattgagctcgcggtatttcatgccgctcgtgttgaaaaatttcttgagatccagcccgcttttttcataaagcgcttttaattcttctttgcttggcggctgctcagcaatatgtatttcgtttatttctttcccatgctcttcaagccacttctttgctttgcggcacgttccgcatttagggtaccagtaaaaagttaacgacatcttcttccccctcaataaaataatcgaggttattttaacacagtttgttttaaaaacctaaaacagtgcttcttaaaaaagagctccgcgcatgcggagctcatggccaatcagacagtatatttctcagcctcaaaaatgcctgccgccgcctcgcgttttttctgaatcacgtttttaggcgttacgcgtgtcagcttgcgcagagcggaaagcatcatgcggagtgaatctccttcttccattgcgataagggattccttcgcatgcgcttcaatttcgttaaaggcctcttgaacgaaaatttctgtgtacagcaccttttgcgctgctttttcagcgccttgtgcggcaatggccttttccgttctgagcacggctgattccattgcgtatacattgctgacgatatccgctacgttcacgagaatttcttgctcacgatcgatcgcttttccgtatttttgcgcggctaggccggcagcaaacaacgcaatttttttggcttgcttgacgatatatttctcctgctctaagacgccgcttccaggctcttcaggcataagcatcatgagttcttcctgcagcgactgcgctttttcgaataaaggcagctcgcctttaagcgcttttttcaggaaggtgcttggcacgattaaccggttgatttcgtttgtgccttcaaaaatccgattgatccttgaatccctataggccctttctacttcgtattcctgcataaagccgtagcctccatgaatctgcacgccttcatcaacgatataatcaagcgtttcagagccgaataccttattcagagagcattcgatggcgtattccgcaatcgatttggcgatttgccggccgtccttgagatcttcggccgtgaactggctcatattgtcttcaaacagcccgacggttctgtatacagagctttccatcgcatacagccttgaggccattgtcccgattttttcctgtgtcaatgaaaaaccagcaatcggcgttttaaattggcggcgctgatttgcatatgccgcagacagctcgatgacgcgtttagatgcgccgattgtgccaaccgccagtttgtaacggccgatgtttaaaatattaaaggcgatgacatgccctttgccgatttctccgagcaggttttcctttggcacttcagcttgatccagaatgagggttcttgtcgatgatcccttgattcccattttcttttcttccggtcccgtggagacacccgggaactctttttctacaataaaggctgaaaacttgtcgccgtctatcttggcgtaaaccacaaatacatcggcaaaagcagagttggtaatccactgtttttcccctgttaatacataatgggttcctgcttcattcagcacagctgttgtttttgctccaagtgcatcagatccagagccaggctcagtcagagcataagcggcgatcttttcgcctgaagcgagtccaggcaaatattttttcttttgttcttctgatccgaaaaagacgatcggcaaggaaccgataccgacatgcgcgccataagaaagagaaaagcttcccgcacgcgaaaatttctcagtgatgagtgccgagctgattttatctaggccgagcccgccgtattcttccggcacatcggcaccaagcagccctagttcgcccgctttcttcaacagtctgacagaatgctcgaattgatggttttcgatatcatctatatgagggagaacatcttgctcgatgtaatcctctgttgttttcgcaatcattttatgctcgtcagtgaaatcctccggtgtatacatttgatcgtatgtgacatcctcgattaaaaatccgccgcctttttgtacgtcagccgctttttttgccatttgtttttccccctttagcataattcaaatacaccggccgctcccattccgccgccgatacacatggtcacgactccaaattgctcgtttctccgtttcatttcatggatgagtgagagtgtaagctttgtgcccgtacagccaagcgggtgtccaagcgcgattgcgcccccgttgacattcactttttcttcatcaattcccaattccctgattacttgaatggcctgtgaggcaaaagcttcattcagttcaaacaagccgatgtcctgcagctgaagtccggcaagcttcaaagcgcgcggaatcgcttccaccggtccgattcccatgacttccggcggcacgccgcctactgcaaaggaacggaatttcacaagcggcgccaggccaagagcatcggctttttcccggtccatcagcatgacagccgccgctccgtcacttgtctgcgaggaattgcccgcagtcaccgtcccatcaacggaaaaggccgggcgcaatgtcgataagatgtctgcagtcgtttgcgggcgaacaccttcatcctgagaaaacacaaactgtttttccataggcttatggtcttctccgatttctgtcaccgtcacttctacgggtacaatttcatctttaaattttccttctgcaagggctttagcagcgttttggtggctgcgaacggcaaacgcgtcttgatcctcacgggagacgccgtattttttcgcgacttgctcggctgtgtggcccatgctcatataatattccggtgccttttctgccaaagcaaggttcggacgggtaacatgccccatcatcggaacttgcgacatggattctgctccgccggcgatcgctgtatcgtaggcgcccagcataattttttctgctgcatatgcaatagactgaaggcctgaagagcaataacggttaactgtaatcgccggaaccgtgtacggcaggcccgcgagcgcaccgatatttctcgccatattaagcccctgctccgcttcaggcgttgcacagccaataatcaaatcgtcaatattgccttcgtaaccgcctgcccgtttcagtgtctcttttacacaaatcgctcccaaatcatccgggcgaacggtggccaacgatcctttttttgcttttccaaccggtgttcttgcacctgacacaatgactgcctctttcataagctccctcctaattccgtaaaggtttacctttcacaagcatatgctgcattctcgcttgagattttgcctctcctgacaaactcaaaaacgcttctctttcgatctccaataaatactcttcatcaacctctgtaccaaacggcacttttccgcccgcaatgacataagcgagttttttcgcgatcttaaaatcatgctcagatatatagccggacagcttcatctgctcagcgccaagcaagagtgccgcataaccggtttctcccggcaccttgaccttttcttttacaggcggccgccagccggtatcgtataaagatgcggccagctgcttcgcatcgtataacaggtggtcttgattcacgctgatctgatccgtttcttttaagatgttcatctcacgagcctcttgagcggaagcggacactttcgccatcgcgattgtttcaaatgttttcattgccgcattcatcggatcatggccgcggcgaagatggttgatgtacagctctttgttacctcctccgccagggatgaggccgacaccggattccacaagtcccatataggcttcgcttgccgcttgaatgcgcgccgccggcaggcatgcttccgttcctccgccgagcgtcatgccaaatggcgcggcgacgaccggtttcgcactgtatttgatcttcatcatcgtctcctgaaaacggcggatcacaaaatcaacttccaaaaagttgtcatcttggacttccattaagatcatggcgagattcgcgccgacgcagaaatttttcccttggttgccgatgacaagccccttgtaattccgttctgtttcctctaatcctttgtggatcatttgaatgatatcgaggccgatcgcattgcttttcgaatgaaattcaagaagggccacatcatctccaaggtcaattaagcttgctccgctgtttttcgcaatcacgccttttgtttctttaagtgcttgtaaatgaattcgttttttattttctttcacggctctgtattcgccgcggtcataataaaataccgttccgttctctttgatgtagaaggtttcatttcctttgtccagcatctcttttatccagccaggcatatctgctccaagctgctcaagcttttccgctgactgcttgaggccgatggcgtcccacatctcaaaaggtcccagttcccagccgaatccccacttcatggcttggtcaatcgcatgaatatcatcggcaatctcgccaagcagctcggctgagtaaagcagggtttgagaagtgatattccacagcaaacggccggccctgtcatccgaataaataagcgctttcattttggcttttgtcccttttgcctgttttgccgcttcaagtgccggtgatttcatttttgtccgctcgccgtaagtaagcgtcactgggtcaagctcataaatcgtttttccttcttttttataaaagccttggccggccttgcttccgatccaccctttttccagcatatcgttcatgaagcttggaaggcgaaacacttctttttcatcgccatcagctttgtcatacacatttcgggcaacgtgggcgaatgtatcgaggccgaccacatcaagcgttctaaaggtggcgcttttcggcctgccgatcagcggtcctgtgatcgaatcaacctccccgacctgataaccgcctttcagcatttcttggactgtcacgagaagcccgtaagtcccgatgcggtttgcgataaagttcggtgtgtcctttgctgtaacaacgcctttcccgaggacattttctccgaaagctgtcataaactttaaaatatcaggatccgtttccttaatcggaatgatctctagcagctttaaatagcgtgcgggattaaaaaaatgcgttccgagaaaatgggctttaaaatcatccgaccggccttcagccatttcctgcactgatatgccggatgtgttgcttgagacgatgcttccagtctttcgatgttcatccacaagagcgaaaattttctttttgacttcaaggttttcgacaacgacctcaataatccaatctgcttctttcagtttttctgcatcatcctccagattgcccggtgtaatataggaggtatttttcgctgatgtgaggggagcgggcttttgtttcagcagttttttcaccgcctgccggctcagcctgctgcgcatctccggactgtccttcgtcagcccccttttttcctcttcctttgtcaaatcgttcggcacaatatctagcagcaggacaggaattccgatgttagccaaatgcgccgctatcccggaacccattacccccgatcctaaaacggctgccttccgaatgtgtttgtgcatgagatatcccccttgaacattgaatgaatagtcattcattttttgaccaaaaaaaatgaaacccgtttcttctttcatcttaaaagatttccggttcgacttcaatagctaatttgttatttttttgtatgaagcctataaaagtcgggcaacttaagcccggaggtgaagggaatggtacgagagaaaaaaaatccgtcttcagcggcagtcagcgcggcgagcgtaaagggagatgccggtccgactcagcattacggcggcggaaaactgacaagtcaaaatcagcagtataaaaaacataacatggaacaatcataatgcagctgcttcccgcggctgctttcactttttcaaaattccttttaacacaaacgctgcattggcaggccgctcggcaattcttctcataaagtagctgaaccagtccgttccatatgggacatacacacgcattctgtagccttccttggcgagttccttctgacgctccggcctgatgccgtatagcatttgaaactcaaattgcgacgcggggatttgatgttcggtgacaagctgtttcgtaaatgcaatgatgtcatcgtcatgtgtggcgacagccgtgtagttcccgcttaacaactgcagctttattaagctctgaaaatgaaggtccgttcctcttttgtcgggaaacgctacagccgcagattctttataagcgccttttacaagtctgagattcggctttaagtcccgcatctttctgatatcttctgccgcccggtacagatacgcctgaatgaccgtgccgagcttctcaaattcctgtttgcattgcctgtaaatagaaagtgtctgttcataatgagtatagtcttccatatcaatggtcacagcaacatcatattgcttcgcaacggaaagaatggcgcgcaaatgagtaagagcaagttcttctgaaagatcgagcccgattgaggtcagcttaagtgaaagctctgaattcaattgatgttcggcaatggcttgaatggctttcttgcattcctctgcgacttggtttgcttctttttccgaagctgcatactcgcctaaataatcaattgttgcacacaaaccggatctgtttagccttttgacggtcttaaccgccgattcaatcgtatcccctgcgacaaaccttcgtgctccaagccgcgttccgtatgcttttgcgaacttggtaagtgttttattttgagataagaataaaaacacatgtctcagcatccgactccctcccgccgtcatcttcaaaacacctgtatataactcccagtctgaaggaaactataaaatgaacagaaaccaaaggaggatcacaatggataatcagcagcaatctcaaatgccgccttccgttatttcgacaaaggatcatttgtatctcaatgacatgctgaactggaatttgctcgcgatgaagaaagcgcatttcatggcgcagcagtgccaggatcaaacgttaaagcaagaactcgaccgcgtcggacacatgcatcatgatcactatcaaagaatattaaagcacctgcagccaggccagcagcagtccggctacatccaataaggaggcgccagaatgaatcagcaaaatcaaaaaatcagcaacccgcagacacctgtaccgacaacatcggaaatgaatgacagagatttcgtcaacgaattgctgacaaccgaaaaatacatgacaacagcttattgcactgctttgcacgaattcagccacgagtctctttatcaggatattcaatccatttttgatgagtcacaaaaagcgcaaagaaaactatatgatctcatgtttcaatatggatggtattctgttgaagcggaggatgcacaaaagctgcagcagtcctatcaaaaattccagcagaccattcagcagcagtctccttatcagcaataacaacattagtaaaaaggatacgatgttctttagggcatctatcctttttttgtgtaaaatcagttgacttttcatttacgcttatttatatttaataagcattaactattttgtcattaaaatatatatacagtgtatgtaacagaggggaaatgaatatgaagagtgcggatcagttaatgtccgatattcaattatcgcttcaggcgctctttcaaaagatacagcctgaaatgctggaaagcatggagaaacaaggtgtcaccccagcacagctgtttgtgctggccagcctaaagaaacacggcagcctcaaaatttctgaaattgccgagcgtatggaggtgaagccaagcgcggtgacgctgatggcagatcgccttgaacaaaaaaatcttatcgccagaacacacaacacaaaagacaggcgagtgattgatctcagtcttactgacgaaggagacagaaagttcgaggaggttttggcaggcagaaaggccattatggcgcgctatctttcctttttgacgaaggaggagatgcggcaggcggcgcatattacagcaaagctcgcacaagcagcagaaacggatgaaaagcaaaacatgaaaagaggaaacggatgaaaatgagtaaagaaggcaaacaatcaaaacgaacgttattaataacaggcttaattattgccatgtttttttcagcccttgacggtaccattgtcggaacggccatgccgaaaattgtcggtgatctgggcggtttgagcatgatgacctggctgacaactgcatatttgttaacatcaacaaccattgttccaattgccggtaaactggctgatttattgggacgccgcattgtctatgtatcaggtttaattattttcatggctgcttctgctttgtgcggaatggccaacaacatgacagaattgattatcttccgtggactgcagggaatcggcggaggcatcatgatgccgatggcgatgattgttatcggtgacttgttcacaggaaaacagcgtgctaaattccaaggtgtctttggcgcgatttacgggctggcttcagtgattgggccgcaaatcggcggctggattgtagactcgttaaactggaaatgggttttctatattaacctgccagtcggaattattgcggttatttttattgccagaggattacagggacgccagcagactggtccgatcaacttcgatatcgctggtattttcacaatgattgtcggtgtggtcagcctcctgctcgccttaagctttggtggaaaagattatgcatgggattcatggcagattcttgggttgttcgctctcgcactgatcggcattgtcagctttatcatcgtagaatcaaaagcaaaagagccaatcctgccaatgtatttatttaaaaacagaacatttacatttctaaacttgatcggcttctttatgagtatcggtatgtttggcgccattacgtttgttcctttctttatgcagggaattgtcggtgtaagtgcgtctgaatcgggtacaattatgacaccgatgatgatttctatgattattacaagtatcatcggcggacagcttgtttataaaatcgggattaaaccgcaaatcattgcaggcatgctggttatggccggcggattcctgctgttaacgaccttggatctcgacacgagcaagcttgtcgctacatcttttatggcgattattggtctgggaatgggtcttgttatgccgattctgacattggctttacaggaaagcttttcgaaggaggagcttggagttgtcacttcatccagccaattcttccgttctatcggcggaacattcggcattaccatgctgggagccgtaatgaatgcgagatcaggaaatctattaacagataaattggttccatatttagactctcttccggcacaggcaagctcgtttgccgcccagctaaagggtatgattgatacaaatccgcaagggctgctgcaatcactgttcagtccggacgcggtcaaacaaatccctgcggctttctcatcccatattgtgccgattttaaaaacatcgttgatggattcgctccacagcgtgttttatacgggcctgatctttatcgcagtcggagccgtattcaccttgttcttaaaacctatcaagctatcaaataagaaagcggaagaccaacaagaaaaagagaaggcggcaaaagccgttgaatcaccttcccattaatagagcaccccgcgggtatcaatccgcggggttttttattcaatcatctgggctcttccatttccgaaagaccaatcctcagcctgatttccggccagcatgataaacacatcttcttttcttacaccaagctcggaatgaatccggctcgcgattgagcggtaaagtgcttttttctgttcagttgttcttgactgtttcagtgtaaaatgaatgtatatcagttcatcagtacgctcgacttggagataaaatggatcataaaaaaattcgcttttttcatattgtctgatgacttggaaatagtcatcttccggcacattgatttcttcaatcatcgattggtggatagtcctgctcagtttttgaagccacacttcgcttcttcccgaccgtaaatgaatctgtacaaatggcatctccccgcatccctttctttacagcgtctgtccgctgtcaattgtgataatttggcctgtgagtgattcctgttcaattagtgaacaaatcaatttggcaacatcatctggttcagcaatacactgcagcggcaaagagccgatcatgcttttcattttttcttcccgtccggcccaccatctcgttgccacagctcctggtgctacaccgctcactctgatttcaggcgctaaggcgtgggccaatgatttcgttaaaccgtgcaccgctgattttgatactgcgtaaggcatagatgagccgacaccagttatccctgcgatgctgccgacgtttacgatcgccccggccttgcttttcttcatgaacggtaccactgctctcgcgcaaaaaaacatccctttcacattgacggcatacagctcatcccagacgtcttctgtcgcagcctcaagatcatccattggaatatgccgtgtaatgcttgcattgttgactaaaatatcaaccgtgccgtgtgtgctcacgattgcttgaatcatatcctgcacgtcgctgtttttggatacatctgcttggatggcgaaggcttgcccgccagctttttgaatcttttccactgtttcctccgcttctgattgcgagcgtgaataattcaccgccacaatcgtcccgcgctttgccaattccatactggctgcttttccgattcctgtgccgccccccgttacgagagctattttgttcaagacattcattgccgccactccttgctgttgactaaagtatatttctgattccattgtaatccagctttgatgttacgtataatgattgttaaagatactagatatcactcagattgatagtaaacgaacggaggagttcaaaatggaaagcggagatttacgtgtgtttcaaatggtagctcgtgaagggagcattacgaaagcagccctgcagcttggctatgtacaatcgaatgtcacggccagaattcaacaattggaagctgagctgggtaccacactgtttttgcgccataatcggggcatgacactttctgcaagcggaaaattgctgctggactacgcaaataaaattataggccttcttgatgaagcgtctaaagcgctctcatcctccgcagaaccaagcgggccgcttatgatcggctccactcagacaaccgccgcggtaaggcttccaaagcttctggcatcttattatgaagaacatccaaacgtccagctgtctttaacaacaggacatacgcaatttctccttgataaagttcttcgttatgaattggatggcgcgtttatcggatgcgaatgccatcatcctgagctcgaatcctatcctgcgtttgaggaagaaccagtagttgtttcggctgcctccgtgcccgatgttgaggaagccatcacaaagccgattctcgtttacagcacaggctgttcgtatcgagaaacacttgaaaaatggctgcgctccgtcggtgtcacacagccggtcattatggaatttgggacgcttgaagcaattatcggcggggttacagcaggtcttggcatctcgttgctgccaagaacggttgtgcagaaacatgaagcagaaggatcaattcgattgtacccgctgcctgaagcgctcagccagatgaaaacagagtttattgttcgaaaagattcgtttatcagcagcgcgctgagaacctttatggattcctttacgccagataaaacggctgaatcacaaaaaagcagtctgctataatgtacagactgctttttggctattgtttgtttcgatgcgcttcatttaattccttaatatgctgaatgatctctttaatgccctgctttgcgtcggggtatgtcgcattccaatgcttagcgagcggtggcatgctcttggctatatgcgtgtacaaaatccattgcttcacttcttcttttagctcatcgtttgtctcaccaagcagaagctcagtatacttctccagcaatccatccagctgctcctgaagtttttgttccatttgccatcttcctttcgaaaaaacagcaaggagctttctcaattgaaagctccttcgctgcgttatttatccatgtgatgtgaaagccgcttcctggacaatgcatctgcccctgccatgaggaatgcaaagaggcgttccgaagagcgggtcctgtgtaacctgacagttcatagaaaacacattttgcacaagatcacaagtgatgacctcttccggacggccttctgcataaatccgtttatcttttatggccacaagatgatgcgcatagcggcacgccaagtttaagtcatggagaaccataacaatcgtccggccttccttttcattcagctcaaacagcaaatcaagaatttcaatttgatgcgtcatgtctaaatacgtcgtcggctcgtcaagaaggatgatatccgtttcctgggcaagcgtcatcgcaatccaagcccgctggcgctgtccgcctgacaaagaatcaacggcgcggtcagccatgtcctcaagctttgttgctttaagcgctctttcaactgcttcctcatcctcttttgaccactgcttcagccagttttggtaaggatatcttccttgcttcaccagctgatgcaccgtcagcccctcaggagccgaaggaccttggggcaggattgcgagctcttttgcgacttccttcgtcggaagcttggcaatcgctcttccttccagcagcactgaaccgcctctcggcttcatcaggcgcgctaatgaacgtaaaagtgtcgattttccgcagccattgctgccaataaatacggtaatttcacctttgggaattgttaaattcaactcatcaataataacggcatccccgtatcctaagctcagcgtttctgtagaaattgcactcatacccataaccgctcctttttgctggctttttagcagcactatgtattgcacgttttctatatacatgcttttaagtcaattatcatcaatgcaagtgattccgatattcagccatttgatatggtcatatatccctcattgtagcagaaaacactgactttgaaaatcattttcaattagttttatggacataattgacgtttatgggttttttatcacaagattacttcttgatttctctgatggagccgtccttcagcttcaattttaaatcgatatgatcataatgactgtccagattaaatgctgccagcacactgtgtatcacttctgtttcagccatttggtctgtcacggaaagctcgctcaaaatcattttcatctcatccaatgcttcttctccctcctgattgacaccggagagcttatcctgtatttccgctttttcctgagttccgttctttgtatagattccttcataacggttatgctcaccatccccgtagctcacacgaagcgaaaaattactgtagggaacggacttcagctgggtgacggctgtattttctccttctgcctgctgctggtcttcattgagacggcagcccgcaatcagaaccactgcgagacatacagccccggctgctctgaccaaatgcatatgtttcccccctgtaggattccatttattttaggtatatccagagaatgaaatcctcattcagagaagaattgaaaaagccggggcatttaacgccacggctttttctttaagattcggtcatttgtaaaaaggtttcggcgtcacgcacagccagcttgatggcattctcccagaaatcgcgctttgtgatgtcagcgcccaaatgcttcatcgccaaatcctccactgtcatagaagccgtatcgcgcaatagcgccatatacttctcttcgaatgtgtctttttcttcaagcgccaacgcgtaaataccaagagaaaacaggtagccgaatgtataagggaaattgtaaaacggcaccctcgtgatgtgaaaatgaagctttgatgcccaaaaaagcggatgatattcttctaacgcattgcagtatgcctctctttgcgcctcttccatcagctcattcaagcggctggccggtaccactccccgctttcgttcctcgtagaatctcgtttcaaatagaaatcttgcgtgaatgttcatgaagaacgcaacgcttctttgcactttatcctccagaagaacaagcttttcttccctcgtctcggcctgctggacagtcgcgtccgccactatcatctctgcaaacgttgaagctgtttctgcaacgttcatggcgtaggaacggtttaacggcctgacgttgagcattgcttcctgatggaacgcgtgcccgagttcatgcgcaagggtagagacatttgaggcgcttcccgaaaatgtcatgaaaatccgggattccccgctgtccggaaaactggtgcaaaagccgccgactctttttccgctcctgtcttccgcctcaatccagccgtcccgaaacgctttttcagtgaatgaggacagctttttgccaaacgttgaaaactggctggtaatgatatttgcggcttcatcatacgaatagacctttccgtcagaaccgatcggtgcctcgacatcgtaccagctgagtttttcaaggccgagcatggatgctttccggttcaaaaactgaacgaacggcttcttgttttcagtgatgacctgccacatcgtatcaagtgtttcttttttcatcctgttaatttgcagcggttccttcaggacattctcccagccgcgcgctttataggtttcaagccggaatcccgccaaatgattcagcgtgctgctgaaaatatcttgcttgctctcccaagcttggcggaaacgttcatatactgtttttctgacagtacggtcttgatgatccatcatattctccgcctgaccgacagacaattgcttgttttcaccgttttcctcatacgggatcgtcattttcccgacaaccatattgtataagtcactccaagcgtgatatccgtccaccgcaaggtttccgatcagtttttccttaccggggctaagcttttcggcaaccctctgtcttctttcatttaatatgtaagaaacatcgcgcaatcccggttttgttaacaattcattccacacgtcttgattaatgtccacaagtttatgatctaatgtaacgagcgacgattgaaaatctgcggaaagccgattcatgagtgcctgatgctctatagccttttgatcattgatattctgggcctggaggcaagcaacaaaagcgccggcctgctgaagcttgacggatgtctgttcgaataaatcaagcaacgcggtcagcccttcagcctcttcaggcgattcaggcacctgaaacgcatcagtcctgtcttgaaatgcacgcagactttgtgacagcttctcaatataacctttgaattcttccgattggctcccgcccttaaaaaatgaatcaagatcccatctttggcctaccccttgcagcgccatatcacaaaacccctttccttctttcgttctattatagaacaattctgaattattgtataaaaatttctattacaggcgtcatttcgtgttcaggatagtacaatagctgtagcagtttaataggagggttaggatgaataaaaaaatagccatcgtaacaggagcgtccagcggcttcggtctgctggcagctgtaaagcttgcccgatcatttttcgtgatagccacatcaagacagcctgaaaaagcggaacagcttcgagaattggctgcagcacacaatgtgtctgattctattcacattacagctctcgatgtcaccgatgaacaatctatagtctcattcggaaaagctgttagtgcttacgccccgatcgatttactcgttaacaacgccggaacggcttatggaggatttatcgaggatgtgccgatggaacatttcagacaacaatttgaaacgaatgtcttcggtgtgatccatgtgacaaaaaccgtgctgccttacataagaaagcatggcggcgcaaagattataaacgtgagcagcatcagcggactgacaggattcccagcgctgtcgccatatgtttcttccaagcatgcattggaaggtttttctgaaagcctgcgtatcgagctgcttccgttcggtatcgaaaccgctttgatcgagccgggctcatacaagacatcgatctggtcaacgtcattatcaaattttatgtcggtgcctgctgacgattcagcctatcatcaatactataaaaagatcctttcctatgttcaaaaaaacggagaagaaagcggagatccccaagaggttgccgacctcatttatcaattggcaacaaaacagcacataaagaatttgcgatacccgatcggaaagggcatcaagctcaccctgctgttccgatcgctttttccttggtctgcgtgggagtctatcctgaagaaaaagctattcagctgatctaaattataattattataatttagtattgatttttatttagtatatgatataattaagtcaacagatcacaaggaggacgttatcttatgaaaactgaaaacgcaaaaacaaatcaaacattagttgagaattcactgaacacacaattatcaaactggtttcttttatactctaagctccaccgtttccattggtatgtgaaagggcctcatttctttacattgcacgagaaatttgaagaactttatgaccatgcggctgaaacagtggataccatcgctgagcgcctgctggcgattggcggacagcctgttgccacagtgaaagaatacactgagcatgcatctatcacagacggcggaaacgaaacatcagcatcagaaatggtacaagcattggtaaacgactacaaacaaatcagcagcgaatctaaattcgtgatcggcctggctgaagaaaatcaagacaatgcgacagcggacttgtttgtcggattaattgaagaagttgaaaaacaagtgtggatgctttcctcttatttagggtaacaaaaaagctgaaccttaatcgggttcagctttttgttttttcttagcttgaactgctttctgtctgcttggtcagtgttgcgttcaacgttttcgtttttccctttcgcagcacttggattgttgttttatctccgacttttaagtctttgtaaaggatctgacggatatccgcactgctttccacgtctttaccgtttagtttgacaatgacatcctcagatttaatacctgctttttctgccggcgaatttgcttgaacttcttttacataaacacctttgcccaattgatctccaaacaggccgagcgtattttcctgataggtttcaggaacttgtgacatgtcaatcatctgcacgcctaaaaacggacggtccaccttcccgttttgcagcagctggtcaacaatcggctcgacatcattgcttgggatcgcaaatccaagtgattccacgccgctttcgctcaccttcaagctgttgatgccgatgacctggccgcttgcattgattaatgggcctccgctgttccccggattgatcgctgcatcagtttgcagcacgttcatttccaccgtcccttgtgttgtatccacatcaattgtccggttcaatccgctaatgatgccttgtgtcaccgtaccggaaaactgctgtccgagcgggttaccgatagcgattaccttttcgccagtgcgcagctgtgaagagtcaccaaagctcgccactttttttacattcttgccgctgatttccaaaactgccaaatcagtaatggtatcgctgccgacaagcttggcagtttccgtttctccgttgtatagcgtaacagtcagcttgttcgcgccttcaacgacatggttgtttgtaatgatatacgctttatcgctgtcttttttgaaaataacacctgacccggttccgctttcactttctgagctggagcctcctcccgtgccgaatgtgttattttgagaggtttggatatttgagattccgacaatcgtaggctctaaatcctctaccatatcagcgatgtttgatgcgttcgttatcggcgccgttgtaaaattatcagactgcacctgtttatttgcggaagcggattcggtcgcctgattttggtctgacggcagataaggcgcgatgccaagcatgaggcccccgccgataataccgcctaaaatcgggctcagccatgcggctctccgtttcttttcttttttcacagccgtttcttgcttttccatttctagtgcagaagccgtttcctgccgtcccgcttcatatgacacaggcgcgtcaagcaattcttgttcagaatgtccaatcagcttctggttttctgtattctgctgttctgtatgtgaaggttcagtttgatgttgatcgttttggccatcacgtcgataatccatgttcttacactcctttaacggttattcatttatcgttacatattcatcgcatgtacaagttcaattgtcccaataatgaggagaaaagcaaagcaccaaaatagaatatgtttgatcatcctacatcttcctcgctctttttctcttcctttcttcccttatacatatcataaacaaacattgtgggataaaaatgaaaagaatatgtgaaattatgaaaattgcctgccgtatgttaaaactagtttataatgacgttgaaaggatgtgaagagccttgtcatacaccatttatctagttgaagatgaggataacctgaatgaactgctgacgaagtatttagagaatgagggctggaacattacatcttttacgaaaggtgaagacgccagaaagaaaatgacaccgtctccccacctatggattctcgatatcatgctgccggataccgacggctatacattaataaaagaaatcaaggcgaaagatcctgacgtgccggtcatttttatttccgcccgagatgcggatattgacagagtgcttggcttagagcttggcagcaatgactacatttcaaagccgtttctgccgcgggagctgattatccgtgtgcaaaagctgctgcagctcgtatataaggaagctcctcctgtccaaaaaaatgaaattgccgtctcctcgtatcgggtcgctgaagacgcccgcgaggtctatgacgaaaacgggaatattatcaatttgacgtcaaaggaatttgatctgctgctattatttatccatcataaagggcatccatactctcgtgaggatatcctcctaaaagtgtggggacatgactacttcggaacagaccgggtcgttgatgatctcgtccggagactgcgcagaaagatgcctgaattgaaggtggagacgatttacggtttcggctacaggatgatgtcatcatgaaaaacaagccgctcgcgtttcagatatgggttgtcatatccggcatcctgttagcgatatcgattttactgcttgtgttattttcaaacacgctgcgagattttttcactaatgaaacgtatacgacgattgaaaatgagcagcatgtgctgacagagtaccgcctgccgggttcgattgaaaggcgctattacagcgaggaagcgacggcgccgacaactgtccgctccgtacagcacgtgctccttcctgaaaatgaagaggcttcttcagacaaggatttaagcattctgtcatcttcatttatccacaaggtgtacaagctggctgataagcaggaagctaagaagaaacgttacagcgccgacgtcaatggagagaaagtgttttttgtcattaaaaagggactttccgtcaatggacaatcagcgatgatgctctcttacgcgcttgattcttatcgggacgatttggcctataccttgttcaaacagcttctgtttattatagctgtcgtcattttattaagctggattccggctatttggcttgcaaagtatttatcaaggcctcttgtatcatttgaaaaacacgtcaaacggatttctgaacaggattgggatgacccagtaaaagtggatcggaaagatgaaatcggcaaattgggccataccatcgaagagatgcgccaaaagcttgtgcaaaaggatgaaacagaaagaactctattgcaaaatatctctcatgatttaaaaacgccggtcatggtcatcagaggctatacacaatcaattaaagacgggatttttcctaaaggagaccttgaaaacactgtagatgttattgaatgcgaagctcttaagctggagaaaaaaataaaggatttattatatttaacgaagctggattatttagcgaagcaaaaagtgcagcacgacatgttcagtattgtggaagtgacagaagaagtcatcgaacgattgaagtgggcgcggaaagaactatcgtgggaaattgatgtagaagaggatattttgatgccgggcgatccggagcaatggaacaaactcctcgaaaacattttggaaaatcaaatccgctatgctgagacaaaaatagaaatcagcatgaaacaagatgatcgaaatatcgtgatcaccattaaaaatgacggtccgcatattgaagatgagatgctctccagcctctatgagccttttaataaagggaagaaaggcgaattcggcattggtctaagcatcgtaaaacgaattttaactcttcataaggcatctatctcaattgaaaatgacaaaacgggtgtaacgtaccgcatagcagtgccaaaatagactgtagatgttttgcagtctatttttttatgtgaaagaatagccgttaaaatctctgtaatttgttttgagcggctgtttgcattgatgaacccattttttctctgacaaggtctgcttcggatatttgactttctccactttgattcctctgtttcgcaagcggctgatcatttcgtccaattctctcattctagattcaccctttcgcttgagctttgaccattcggtcatctcaatttataatataaataatacatgataaaaaaacaagttacaataaggttaattttataacagacggtgtgactatatggtcatatcctagcaggcctccgggctccgaaagggtggaaccattgaaggaaaaagaaaaactgattattgaaacagccttaaaactatttgcccaaaaaggatacaactcaacatcagtccaggaaatcgcaaaagaatgcaaaatatctaaaggcgctttttatatttattttccttcgaaagaagcgcttcttctctctatgctgaactactattatgataaaacgtttacccgaattttaaatattaaaacgaagggcgacagccccagaacggcttaccgtaaacagctgaccgtcctctatgaaaacattcttgaacacaaagattttatcagcatgcagttgaaggagggttctctgccttacacagaagaagtggagcaatgcgcaaaaaaaatccgccagtcctcacttcaatttcatatcgacagcctgctgaacatctatggaaaaaaagcggaaccctacactgctgagctttgttttttaatagagggcatcagccagatttacctggaatgcatgattttgctcgggtacactgtgaagccgtctcaattagctgatatcattatgaatcgaattgatgatatggtaaaaggcatgtctgaacgaaacgataagcctttcatcacattggaagaggcgagctctttattcgggcctcttacgcacggacggcctgacccgctgactgaatcaattgtgaaaagcctacgtgacaaaattaacagcttaaacacaaactcctctcttgaattatcggagagcttggacatacttgaagcagaaatgaagaaaaaaacaccgaagcttgcgatcataaaaggaatgattcataatctgacggagtctgaagctctcgccaaagatgcggaacagcttaaatatttattaaaacagcaacatatttagaagaacggctgcttaaaaagcagccgttctttcttcctattacgcctttggttttaccatgtcttccggcttaaccatttcgttaaattgctcctctgtcagcaattcaagcttcaaagctgcttctttgagcgtcaatccctctttatgggcaagcttggcgattttcgccgcgttttcataaccgatatgcgggttcagcgccgtaacaagcattaatgaatttgacaggttttcctgaatggtttctttattaggctcaataccgacagcacatttatcatggaatgaattcatgccgtcactgagcagctgcacagattgcaggaagttgtaaataataacaggcttaaacacgttcagttcaaagttcccctgacttgccgcaaagccgattgtcgcatcgttccccatgatttgcgctgcgatcattgttaacgcttcgctttgtgtcgggttgactttaccaggcataatagagcttcccggctcattttcaggaatgacgatctccccgatgccgcagcggggtccgcttgcgagccatctgacatcgttcgcgattttcattaagtcagccgcaagcgcttttaatgcgccatgcgcataagtgatttcgtcatggcttgtcagcgcgtggaatttattcggcgagctgctgaacgtttggccggtcagcttagtgatctcttctgagacaagctctccaaactctgggtgagcgttgatacccgttccgacagccgttccaccaattgcaagcgcacgcattttatctgtcgcttccaaaatcatttccttcgaacggtccagcatgtgaacccatccgctgatttcctgtccgagggtcagtggcgtagcatcctgaagatgcgtgcgtccgattttgacaatatcattgtatgcttttgctttttcatccagtgtattgcgaagctgatcaagcgccggcacaagctgctcgtaaacagccaaaacagcggcaacatgcatcgcagtcgggaatgtgtcgtttgagctttggcttcggttcacgtcatcatttggatgaatcgtttgatcagagttcttctcttttaataaagcagtcgcacggttggctaccacttcgttcatgttcatattgctttgtgtgccgcttccggtctgccatacgacaagcgggaagttgtcatcgtacttgcctttgagcacatcatcacaaaccgctgcaatcgcttctgctttttcagcgtccagattgccgaggcgtttattagctagagcagtgcttcgttttaaaattgcaaacgccttcacaacacgcatcggcattttttcagaaccgatcttaaagttctccttgcttcgctgtgtttgggcaccccaaaatttatcagcaggaacttttacttctcccatggtgtctcgttcaattctgtattccatttatgtatccctccataacggttgcttcaatagatcataattcgccaatgacacaaaaaatcctttttatttttcgatcttggcagattttaattttaattcaagatatacgcgggaatcctttgaatatttgtattttggatttgtcctgccgtactcctttgatgtataagagacatcataatgctgttcaaatgatctaatgagctgttcaatttcttcttgttttccagctagccttacctgtgccacttcgtatcctccgctttcataaaaaaacttactccatgaaatactctaacacagtatatcatttttttaacaggaaaagataacctctactaaggttttggataagaggtgacctcattggaacaaacagagtttaaggaatatatacacgataatttagcattggtgctgccaaaattaaaagaaaacgatgatctggtgaaaaacaaaaaaatgcttgcgaacggactggttttttactatctctatttcagtgaaatgactgatgagaataaggtgtcagaagccattaaaactttgattaaagatgaggagaccttaacgcttgaccaggtcaaaaaacgccttgaccagcttgacgcaagacctgttgaaactgcaaaaaaaacgattgaatcgattctcaacggcaattgtgctgtgtttatcaacggattggataaagcctatattctgaccacaggaaagaaaaaaacaagaagcctgacagagccgacaactgaaaaagtggttcgcggcccaaaagtagcgtttgtagaggatattgatacaaatctcgctctgatcagacaaagaacctctcatccgaaattgatcaccaaaaaaatcatgatcggcgaaaacaagctgaagcctgcagccattatgtacattgaaggcaaagcaaaaaagtccgtcataaaagaagtgaaggcgcggcttaaaaatatccagctggaagatatccaggacagcggaacgctcgaggagctcattgaagataataaatattcaccatttccgcagatacaaaatacggaaagacctgacaaagtatcttcagccctgtttaacggccgtgtggcaattttggtcgacagttcaccatttgtgctgctggtgccggtttctctcggcatcctgatgcaatccccggatgactactatgaacgctggatttcagcatctcttatccggtcgctgcgctttgcttctatctttatcaccttgtttttgtcatcgatttatatagcacttgtttccttccatcaggggctgctgccgaccgcactcgccgtcacgatttcggcgaacagggaaaacgtgccgttccctccgatatttgaagccctgctgatggaagtaaccatcgagctgctaagggaagccggactgcgactccccaatccgctcggacagacgatcggcctcgttgggggcgtagtcatcggacaggctgctgtagaagcgaatctcgtcagttcgattatggtcattgtcgtcagtgtcattgccctggcatcctttaccgttcctcaatacggaatgggtctgtctttccgggtgctgcgttttatttcgatgttttccgccgctattttagggctatacggcattattttatttatgcttgtcgtttatacgcacttaacgagacaaacgagctttgggtctccgtatttttcgccaaacggattctttagcctgaaaaatacggatgactccattatccgtctcccaattaaaaacaaaccaaaagaggtgaataatccaaatgagccaaaaacagactccactgaaacttaatacctttcaaggtatttctattgttgcaaatacaatgcttggggccggacttttaacattgccgcgagcgctgaccactaaggctaatacgcctgacggctggatcacgctgatattagaaggtttcatttttattttcttcatttatttaaacacgctcattcagaaaaaacatcaatacccttcactctttgaatatttgaaggaagggcttgggaaatggatcggcagcatcatcggccttttaatctgcggctatttcctcggcgtagccagcttcgagacacgggcaatggctgaaatggtgaagtttttcctgctggagagaaccccaattcaagtcattattttaacgtttatttgctgcggcatttatttaatggttgggggcttaagcgatgtgtcgcggctgtttcccttttatttaacggtaaccattattattttgctgattgtgttcgggatcagttttaaaatttttgatatcaataatttgcgtcctgttttaggcgaaggccttggacccattgcaaactcccttaccgtcgtttccatctcttttttaggaatggaagtgatgctgtttcttcctgaacatatgaagaaaaagaaatacacgttcagatatgcgtctctaggatttctgattccgattatcttatatatccttacgtatattatcgttgtcggagctttgaccgctcccgaggtgaaaacgctgatttggccgactatttctctctttcagtcctttgagcttaaaggcatatttattgaacggtttgaatcctttttactggtggtctggattatccagtttttcaccacatttgtcatttacggatactttgccgctaacgggctaaagaagacatttggattatcgactaaaacaagcatggtgattatcggcataacggtcttttatttttctctctggccggatgacgccaatcaagtcatgatgtatagcgattatcttggctatatttttgtctccctgtttctgcttccgttcattctctttttcattgtagctctcaagaggaggattacaacaaaatgaaaatccggattttatgtatgtttatatgcaccctattgctgtccggatgctgggacagtgagaatatcgaggaattaagcttagtgatcggagtagggctagacaagcctgacgatgaaaatttagagctgacacagcaaattctcgtgccgaaaataatcagcgccaaggagggctcttcatctgatccgacacagctttctatcacaaagggtaaaactgtccatcaaatgatgagaacctctgcattaaagcataagcctacgttttcacagcatttgcgtctcattctgctttccaaaagcgtgattgcggatcaaattggaatggacgccattattaaccagtttgtcagagacaacggaacaaggaggagttcctacgtctttatcaccaacggccgaactaaggatatatttaacatgaatgatgaaggcgaacccgcatccaacgtgatatatgatctgacagagaataataaggtgacgatcagaacgatggagccagttacattgggggagatctcagaacacttaacctctgacgattcattcctcatccctcatgtcggtaaggaaaacggcaagctcgcgataaacggagcctctatcataaaaaataaattatggcaccgggacctcaccccgattgaggttcaaaatatcagcttattttcaggcactgtcgagggaggcgtcattgacttgaagcgcgatggccatctcttttcttatgaagtatattcaagcaatcggaagatcaagacggcatacaaggacggaaagttcaaattcaccgtcacccgcaatattgaaggtcgtctatctgaggactggaatcccaatgaagactcgtttaaggattcatatattaaaagtattgaaaagacagtcgaaaaacgagtacacgaaacagtaacgtcatttattacagagaagctgcagaaagagatcaaagcggacgtaaccgggctgggaaacgaggtcagaattcattatcctcaaaagtggaaaaagatttcaagaaaatgggatgatgattatttcagcaatgcggaaatagactaccgggtcaatgtgattgtcagagacttcggaacgaaaggcgcaaacaaatagcagccgcctaattcacgagatgatttcggtgcgcgtacaccgccgcctgcgtccggtcactgacatccagctttgataaaatattcgtaatatgtgttttgactgttttaatcgtaataaacagttcctcgcctatttctttgtttgtctttccttctgcgatcaggcagagtatttcgagctcccgttttgtaagcgattcatgcgggagcgcgttttcacctgagtggcgcagcctggataatacttttcccgccacttttgactccagcttcggctctcccttgcttgcggcgcggatggcatcggcgatttctgccgcttttgaggttttcaacagatagctgagcgcgccagcttcaataaccgggtacactttgtcatcatcaatgaagctagtgagcacaataattttcgggtcggaaagctcccggcaaatttgctttgtagcttcaatgccatccatgccctccatgacaaggtccattaaaatgacatcaggcgacagttccacagcaagccgaacaccttcgctgccgtccgatgcttcgccgatgacttcaatatcgggctgcgcctccaaaaaagccgcgagccccattctgaccatttcatgatcatcaatcaataatactcgaatcacgttcgttctctcctttttcttccggaaaaatcgggaccttcacttcgatttgagtgccttttccttctactgaaatcacttcggcgacaccgccgatttcacttgcacgttctttcatagaattcaagccgtatgaggaggctttcacctggtccattttaaagccttttccattatcaatcaccttcagacggagctggctgttctttatgcccagaatcacggttacttttgacgcttttgaatgtctaaatacgtttgaaagggcctcctgcacgattctgaacaagtggtcttcaacacccttggatatcgctgtgtcctgtatatcccactcaatatcaatcggctgcttttttcggaactcgtccaaaagctccgtaaggccctccttcagcccttttccttcaagggtaacaggccgtaaatggagcagcagcgccctcatctcattttgggcttcgcctgccatatgctcgaccatcttgatccgcttgactgttttgtcatcagcatccttgacatgttccagcacggctgatgtcatcatcgatatggcaaagagctgctggctgaccgcatcatgaagatctctagccaatcgctggcgttcttctgagataaccgacttcttcatttgagcctgccattccgcacgttcattggaaagtttctgcagggatgcgacttgaagctccacgcgcttcgccatttcgttcagctgatcagcggccaggccgatttcatcatcaccgagcggaggtatccgataagcgaaattgccgttttcaaaggttaaaatggattcaattaatgtatcaatccttgtcttcaaccggttgccgtacatataccctgaggcgaaaccgactgtcacgctgatcagaagcaaaatcaggataaacggaattccgaaccagcttgatgacagcaaaacaagcggatcgagccgatagtaaaacatcataaaggaaatcaggcaggcaaaaaggagcaggctgattcccgttgtcatgcggatggcgcgccattggaggctggcaagcattttttttctcatacgtacttcacatccacatcaccgataaataaggaaacggacacttttacccggcgctttgactcgctgaaatcagttgacgcggcatataccttcgtgcttaatccgcttttcttcgagccgatcagattaatgtcacctataaaaacagctgagctgacagccacttcaaggtccgatggtacataaatatcaacgttaccaatgactccgctaatgacgattgtactttctccctcgggaatcattgctttagataaatcgattttgatatcaccgataaaaccagagacatttaaatcattcaggtcaaacggctgcttcatcatttgcagctcaccgataaaaaagctgcgcatgtcgggatgttttacatcttttggcggatcatgatgttcttttttattgagattgacctgtttctcattcggttcaaatatcggcttccctttgataagcctgtagccggcgtaaatcagaaatgcggcaaacgcatagccgaataaattaaaggtgatgctgaagaggtttttcaaaaatagaaacgcggcaaagatatacatgacggagccaagccaatcacgggaatattttttaaggaaatagccggcaatcagaaaaaagagcggccaaaacagcagatcgcctattccgataatttgcaaaaacatactgatgccgaataaagcaatgatcaatccgagaagctgtttttttgtcattcctggtgtccgcctcctttcttctgcctagtgctaccgtatcgctagatccccgctgtccgttttgatgtcgattggatgctggccgcttccttgcgtgcctgtgatgtgatgctgttctttatgtgctttatcagcaaatgaatacggcgaactgacgtcaccgcttgctgataaagcattgactgcaaagctgccgttttggggaaggcttacattagcatcaccgcttgtcagcgtgacagatacgggaccggttacctttttcaatacagcattaaaatctcctgaagtcattttcacatcaagagagcctgatacatgaaccagatttgcgtcccctgaagctaaatcaatgccggctgttttggagacggtatttgaaatggaaacatcccccgatgatgccttcactttcagatcttgaatgcggacgtccgtcacgctcgtatttccgctcgcagatactgcgttcagcccggaaagcgcaagatggtcattcccggccacagacacgtcaccgcttgaggttcgtactgccagatcacctttataatcatacggaagcctgacgataagagttgaacggttaaatccattcaaaaattgaaattctttttcctttacggtcagctccagttttcttctgttttcagtaacaaataactttcctgagtctcctgaaatgcctgccgatatgtcacttcgttcttccgctataatccggacatccttgctatccgactcaatgaccatgctgtcaatgtcccgcggcgatgcgctggctgaatcagcttctgtgccatttatgaaacccaggcctgcagcaaacacatcttttacgacaacagcgaaaaaaaccagaataccggcagtgatcaacagtttgccaagcatttttttcattcggtttcatccttctcattcattctattataaaggaaaagcttgcgaattgatacgtgcggaaggggaaggacttgaccgcaaatccttccccgttccgcttattcatttgccgcttgtgtctggtctgatttttgcagtgaaagtgtccgcattttttcaatctccgcttctacatcgtctgcgaattctttacgtgtaagttctgtgccggcttccgctgactttgaataattcgcgcggatttccatttcttcaatacgattttcaatacgcaaaaattcacgatacgcgctttcactgtcaattttgtcaaatgtggtattcatatgctctttagctttcgccgcatttgcccgcgcaatcagcgcctgttttttatcctttacgtcctgaagctttgtttcaagtgcagccagttgctctttcagatcggccagctgactgtttgcctgttcataggaagctttatgctcagccgcctttccttctaaatacttcatttcagtcagcgcctttttcgccagttcttcttcacctgcgtcaaatgcgagctgtgcctgatttttccgttttccagccacttcagcggcttcttcatattttttcttaaattgataggcaatggtgtgctgtttcacaattgtttgctttgcttttgcgatgtcgctttccatatcgcgtacatattgattcagcatcacctttggattctccattttatcaagtccttcatgaactgacgcaacaaacatatctctgattctttttaataccatacctaattcctcctaatatattgatattattttttcttcaaaaattcttcccattcatcatcaaagtgagattggtaggcagcagaagccggttcaggatcaaaagatgatacaccgttatcagctgatccgtttttcatcagcttccagccgtaatacaccatagcggccgccaatgcgattccgacgacaaacggaagtgagcagatgagcataatggctccgataccgcccacgatgattcccgtgatggtttttcccgcggcaaaccttttgactcctgcgtatgtcatcaagctcccgatggcgagcgggatgataaagccgaagcttcctcctccaaaaaagacggatatcccaaatacaattaataagaatccgcctatagttttcttgttgatcttcatgcagatcctcctttcgttttccttgtcttcatcttatacaagttagaagatatgcaaaacgaatcagagattgatttttatataagaccggagtcgtatctcggacaggacccatcggcacaaaaaaacgccatgcacgaggcatggcgttttaaaaccctttacagatgaacacttgcttccctttctttaatcaggtcggacctttctgctttggccagttttgtaaacagcaagattccgatacccgcaataatttcgacaatcccgccggcagcaatcactgttcctgagccgaaagcattagcggcatacccgcaaatgacagctccggcagggatcgaaatatttgagatcatatgtataacggcgtaaacctgcggctgatcctcactatccacagacgtctggataatcgtgtactcaggaacattaacagcactgactgcggcaccaaaggtaaaagcagcgaaaaagacgagcggcaaaaaggtattcatccctgtaataaagaaagcaaatccttcaataatgccggcagtgacgaataacaagccgtacctgtttaccttgactttcgccagcacaaaccctaataaaaacgcgcccgcggcggtggtggcctttaaaagcgagtatacgatcggctggccgtttaaatcttccgcaacgtatacggcagagagcgcttcccatggggcagccgcgaaattcataaagatacagtaaatggcgagcggatataaaatctggtgttttctgacgagcctaaagccgcgtttcagtcttccgatatatgtgcctctctgtgtaacaaccgcagactctgattgagattcaaccgcagtgtacttaataaaaagaacgagaaaacctgacaccaaatagagcacaagtgcgataagcatggtataagaaggactaataaatgtaagaaaagcgccgcataatgtgacagccccaagccggacaatttgagcggaggattgcagcacagcgtttgctttttgaatgccctgttcattgacgatttgaggaatcaaagcgatagaggcgggattgtaggcagctccagtagctgaatgcacaatcataagcgtcatgacaaaccacagcggagagaagcccgcaaaatgacatagagggataatcaaaacaatcgccgcccttgtcagatctgaaaagtacatccaaaatttcagcgtggtctgtttcataaaaggccccgtcacaggcgccagaacggcttccggcaaaaacgtgacagcaatcaataaagcagtgccgatcgcacctttgccgtcataaattaaaaaccataatattgaattaaatgcgaacatatcgccggatatcttgactattcttgagaaaaacagataattgaaatttctcttccagatgctatcactttcaattaaattcaccatccatcagagccccccgttgcctattttttacatctatttattacaatatctcatttttccatttttcagtcaataattcataaggttcattttttgtcgtaaaatgggaaattgacagagtgaaaaacaaaaaaagccggcatgtatttgaacacgccggcttccttttcactttttatgattcgctgctgtttcggtcccgaaacacaatggcacttctttcatattctacatcgccaataccgcttcttgcattcacaacccgtgcggcggcaaagaaataatcggacagacgattgagataacgcagcactgtttcatgaatctcctccgatttcatcagcgccaccactcttcgttctgccctccttgtaatggtgcgggcgatatggagaagcgaagcacctcttgatccgcctggaagaataaatttcttcagttccggcgcttctgctgtataggcatcaatgcgcgtttctaaaaaggaaacagattcttccgttagtttgtagtcttttctttctgtgacgattgccagatcgcctccgcagtcaaacagctcatgctggatggtcagcagctcggctgtcagatcttcaaagccgggctgcccggaaagctctgccaaagcaagcccgataaagctgttaagctcgtcaatcgtgccgtagctttcgacgcgtaggctgtccttgtccgttctgcccccgactaagcccgtttgtcccttatcgcctgtttttgtatatagtttcataccctgaatctcctttacagacttattcaaacaactcagcagcctcttttacacattcagctgtccctttctttatcaattgattcagccgctgttctatgttttcggattgctgagtttgagtcgcggcgatgagaatatcacctgtgcctcctccgtctcccagcactttcgtccgttctgcttcggcagccataagagctttgatgaagaattgatctgccgcatagccgtttatcaaaatccaaatcgaaaagccggtctgaacgcatatgaaaacggataactctctgtcttcatacgttcgatacacgaaacggtcaagtctttctgaagaagccatcgcacacgtctcctgcagttgaaaaccgctttctgaaagacaggccgtaagtccttctatcggatctggctgatctggcagccgtttatggatcagcgtcctgctccacgaaaaccctgcaccgataggcgtcgaggacaatgttcgaagcgggatttccgtttgcagaagaatgtcatcacgccccgcttggagcaatgcttcaaatgggatagactgccgcttcacgctatctttttcaggctgaatcacaatcatcggtttaggtgagctttgatgaaccaaggcggtgacatctgtatcgtacaccgcctttatgctttgttctgtaacagcatattccggtttttgcttaggcccggcggtaccgtttttcataaacatgagcccatcacagtacaggcttgcggtgttcagatcatgaaaaacgctgacagctgccaatccgctttctctcgtcaggcgtttgatcagatcaagcaggtctttttgataagccagatcgagaaaattagtcggctcgtccaaaaataaaatacgcggctgctgcgccaaagcttgtgccaaatacacccgctgctgttcccctccgcttagttcgcgaatcggcttttgcgcaaaatcggccactcctgtttgctccattgcttcctgtacaatggcttcacccttttcagtctgctgtctgaacagccccgtttggaatggatatctgccaaaggctacagtttcttcgacagtaaaggtgaaggcttgatccattttttgcggcaggacagccatgatttgcgccagttccttcggtttatagtccgccagcagttttccggccagataaaccctgcctttcttggccggcagcgtacctgtcagcaagtgcaaaagcgtggtttttccgcttccattagggccgagaattccaagaaattctcccttctccactgttaagctgacattgttgattaggcggctgtcgccgtatcctcccgacagcccttctgccttcatcataagcttctccccccgcgatgctgccgaattaaaataagagcgaacacaggcgctcccgccaaggacgtaatgatcccgatcggcagttcaatcggctcaatgatggttctggaaagcagatcggctaaaacaagaaaccctgccccaagcaaggcggacaacggcagtaaatgccgatggtccgttccccacaaaagccttgtgatatgcggaatcacaaggccgacaaagccaatcgtacccgatactgccacagcgcttcccgtcaaaagagatccggctattaaaatcatcatcttcctctgctgaacgctgactccaagaagctttgctttatcttctccatatgtcatcacgttcagttcccttccgtttataatcaataaaatggttcccaaaagaaaaaacgggagaaacaaaataacatagctccagcccctcattgagacgctgccaagcagccaatgcacaatcggaagcaggttgtctcctgtcaaggcgatgataagagaaataaatgcgcctaaaaaagagttggtgatgacaccggtcaaaatgagggtggaaacagacatcgaagcatgaacgaggcggctgaagaaaaggaccgccgccatcgtggccagtgccgcggctacactcaaaaccgggagtgtaaaccctccgatgacaggaaggtgcaaacctaagaacagagtcacaacagctccgactgaagcaccggatgacacacctagcgtatagggatcagcaagcggatttttcaacaatccttgaaaagcggcccctgcaatagaaagagccgcccccacaagggcggccagcacaactctcggcagtctgatattcatcataatattagtgtacatcggatcatcagaaccgatagagccgccgaaaccttgatgccaaaagacacgaaaaacagcgggaataggaatatgcaggctgccgcaagaaattcctaagatgatgctcacggctaaaaatgagaaaccaatgatatatgcggcataacgattattccttaaacgtatccgggtaaatgctttccgcaagttcttcgaccccttcgatcagacggggaccggaacgtgtcacaagatcagggtccacatcatatacacgatgatgtttcacagcattgatttcgctccagccatcgcgtttttccacagctttcgctttcacaccgtccgttgtaacaattgcatcaggattgagttttacgatcgcctcgtctgtcatttgcacccatcctgtctgatccgcagctgcgtttttagcatggatgacatttagcatttcattcataaacgtatcttttccggttgtataaatgtcaggatcaggagaaacctcgataaatacgcttttctcctcgtcttttgaaatggttttcgctttttcttgaatatcctttagatctgatttcatgcttttcacgagctgatcggcttttttctccgccccgccagcttctccgatcatttcgattgatttgtacacctcggagaatgattgtgcatcattgacagtcagcactgtaatgcccgcgtccttcagctgtttgatggcatccgctgatgctgacatggaagactcatgggccagaacgagatctggttttagagaaatgactttttcaacgtttacattcatatctccgactttctcaacctttttgacttcctttggataggtatcgtttgtggtgacaccgaccactttgtcaccaaggccgagtgcgtatgtaatttctgtgttgctcggcattaatgaaacaatcttttttggctcttttttgatggttacatcttggtttgacgcatcatcaatggtgacagggaacacttctgttttttgttttgcctttgaatccttctgatccgcaggattgccgcagcctgccagcataacagcagccaacagaagcgcagcccatatcccggctcgttttttcataatcttttcctcctaaacgaactaaaaaagcatctctacgacggtaaagatgctgtaaacaacacaaaaaagcctattgtttacacatcatctgtcctcgcagaattcgtgctgatcaaacaggcaggtatcctggctcttggcgcttggccaattacagtggcgggaccgcaccggcttttaccggtttcccttttaagccggctgttgttcacggaccggcacctatttgacattcgtatccgtttttcggagtaattatactatatgactgacaggcttgtatatgtgtcctgaatgacttttccccatattgtgtatggaagcaaaatcctcgtaaacactaaatttgatcttgtatacttaataccatcatctatcaaaaggaatgattcttatggatttacagctaaaagaaaaactcgtcttaatcaccggctcgacgtccggtatcgggaaagccgccgcaaaaagctttctgcaagagggtgcggcagtcattgtcaacggacgcaaacaggagactgtcgatcgcaccattgaagagctttctggctatggaacagtgcacggtgctgctgccgatttgtcaaaaacagatgaagcagcggcttttatcgaaaaagtaaatgaaatcggtgatatcgatatccttgtcaacaaccttggtttcttcgaggtaaaagacttcgccgatgtgacagatgaagagtggaatcaatatttcgaagtgaacgtgatgagcgccgttcggacaagccgtcacttccttccaaaaatgcttgccaaaaacagcggccgcattttaaatattgcaagtgaagcaggcgtcaaaccgctgccaacgatgattccatactcaatgacaaaaacggcactgatcagcctttcaagaggaatggctgaaatgacaaaaggcacaaatgtgacggtcaactcagtgctcccgggacctacttggacagagggcgtggcctcctatatggaaggcgccgcacaagcagccggacaggatacagatacatttatcaaagactatttcaaggtcaatgagccaacctcacttattcagcgatacgcgacagcagaagaagtcgccaacacaatcgtattcctcgcgtctgacgccgcatccgccattaacggcacggcacagcgtgtggaaggcggcattatccgttctctgtagtataaaaaacgcatccgttgtttcggatgcgttttttttatacgtctccagcaaatggtaccggctgatatccgcctgtttccagttgtgctgaaaacaaccctccagcgtgaggctgctcgtatctctctttttctgtcatttgttctgttgccgttgtaatgtaaagggtttttaagtctttgccgccgaacgcgcagcacgtgacatatttagccggcacgctgattgaattgatttcttttttctgaaacgggtcaatgtgaacaacgcggctgccgccaaacagcgccacccacagcatgccattttggtcaattgtcatgccgtccggcaatccgtccgactgatcaaaacgatagacaggttctggattcgaaacatccccgctttgaggatcatagctgtaacgtacaatctcctgggtcggcgtgtcgatgtaatacatcaaattccgctcgcggtcccaatccaaaccgtttgaggtggagacttgatccttgattttgacaagactgccgtctagattcaaacggtacagcgacgcctgtttttgctcgccttccatgctcgtcgtccccgcccaaagccttccgtacgggtcacatttagcatcattaaatctcaggctctcatgcatgtccttcggctgtttaattttttccaagctgtcatcccgaagatgatacaggtaaaacccgtccttcatcgtcataatcagttcatcctttgaatatttcgcaagcgccgtcacaaaggatttgaatttgattgatcggttgattttttcttcagggtcaaagatgtggagctcgctccccaggatatcaacccaatataagcggccgttttcttcatcccataacgggccttctccaatcactgcccgagtgtctgcttccaatactgcatccatgtgttacacctctttagcttcagtctatatattgttattcccggcaaagaggtgtccaaaccacttgatgtttattgttttttaaaaaggatggtaatgaccgttccaatgttcattctgctgttcacatggatcgttccgttatgcagatggacaagctccttggcaatcgcgagcccgagacccgttccggcagttgaatcttttgtgttcgtccctctgtagtaacggttaaacaaatgggtaatcgtttcttcatccattcctttcccattgtccttcacctttaaagatatatgattttttgtttgctccagaatgacttgaatctctgttcctttgtcgttgtgcttcacggcattcccaaggaggttttctaatatgcgcctgaaccacgcttcatcaagggcaaattcaatatgctcttctttggatacaaacgagatatcatagccttcagaaaacggatttttcttaaaatcctcaatgacatttttaaaaaacgggataaggctagtgagatttctctcaataggaagagcatcatttttcagccgatacgttaaatttaagtcttcaatcagcttagacatgtattcagatttttctctgacaacctgccccatttctttcacttcttccggcgaccagtcatactgcttcgactcgagcatcatgctgtagccgtaaatgctgctgagcggtgtttttaagtcatgtgacaaaccggcaatccattcttcccttgtcgcctggattttttctctgtttcttttatcccttctcagcgtttcagtcagctgatccattgattcaaatatctcaccgaagaagcggtacggctgtttgatttttccctttttatttttgctgacaggacggccttcccggtttctaggttcctcaagcttcccttttgacagattgaccagccatctaatcgtgtgaaaaatcggcagcccgaatcggaacatataccaaacggtcatccaaatgatatacatgaacaaaacggccatcacgagaaacatcgcttttaatacaaccttcaggaatgatttgttaaactcctgatcggttacatagactgggtttggcaccgtagcgaccatccatctgtctttattgaggatcttaacggaaatttcccgcttatagttccaaggcttagagctgtatttaagcagctccagctggttcatcgtttttctttcgctttttgtgctattgatgctgtcgagaatctttccattgctgtctaacaggtaaatggcgccttttttccgtttaatatagtcgatggtactagacttatagtgcgctagtgagtctatcttttgttcacgcttttcaacggaagtcaggagctgttcactttttgatttccagccggacaatagaagatacgacttatcttcaatattgatggcccaataattcagtttatagttatgaagctttttggttttataaatagacaaaagctctttcttggtataggtgcccggcacgtcttttggcacgccgtaggaataatcagtgtttccttccgaatcaatgatttgcatccagccgtgctgtttatcaacagatttcttcaggaaattatccacttcccatgtcccgtcttcgtttacatcgagatatgcctcaagtgtgtcggtcgttgctttcgtcagccctgaattggattccgcatcgctaaaacgggcgtctaaatagaaaaacgatgcaacaagcataaccgtaagcagcaggatcacaatcagcatctggccgaaaaagtgaaacaaaaacttccatcttaacctcatgaccgcttgccttcaggatttgggataaaacgatagccgagacctcgaacggttacaatatactccggattgctcggatcgcgctcaatcttctccctaagcttgcgaatatgaaccatgacggtgttgttgtcaccgtaggaaggatagccccatactttttcatatatttgatctttggaaagcaccacgttagggtgttcacaaaaatactgcaaaagctgcagaagctgggctgaacaggcaacggcttccccgcctacgatcaactcggcattttgcggagaaaaagtaaagtaatcatatgtgtaggtttgatttgaactcgtttctttcgattgatatgtacgcttgagatgcgctctgatccgcgccgctaattccagcggattaaatggttttgtgatatagtcatcagctccaaccgcaaagcccgataatttgtccgcgtcggatgatcttgccgtcaggaaaaaaatcggagcgtctgaatactctctgatcaatgtgcaggcttcaaaaccggacattccgcccatcatgacatccagcacaatcaagtcaaccttattggccttcacaacgggaatcgcttcttctgcgcttgccgcatccagtatatttcgataaccttctttttcgagaacgcgtttgatcatgtccacaatcgctttctcatcgtctacgattaaaattgacgcattttccacttttatgttcctttctgtcactgtttttttcatcttatcattatatcgtttatttatggtacatttttgaatacattggagcttggcaaatcaaaacagcaaaaaaggagcaaacaagcgctcccttttgatgttttttcatatgaaaatattatgagttctcatctaccatgtacaaaataaactcccaaaaccccggtacatcctgacataaaagcatatcagccttttcaaacattttgatcttcagctcttgctctaaatcttctctttcttgataggacgtattgctgagtttttttctgatcatcggtgaaaagcatgcaatcaggtgctcaatgtcataagtctcgtctttttgtttctttttttgttcaaactggccgtccacagcttacttttccccctttttttgcgccgctaactgctttctgatattctccagcccctttttatgaatgttggagatgttttgtcgggactcccctaatgaatctgcaatctcctgcatcgtggcaccgtgaagatagactttcgtcagcacacttttttgtttgtcagtcagcttctggatcgcttggtagagctggtaatcctgtacatgctggctcaaatcatcctgcctgtctaaaaattcttcaaatgcatcgctacctgtttcggaaggaagccgatctcccgcctccggatgatcaaccgtcagcggataccgtttttggtttttgcgaacccgcttatcaaaatcaatagaaaagatgcgaatcattgaattcatatacttgacgatgcggatttctttataaaattgcttaaatagctcgtccaatgatcttgcatctttttcgttagggctttccattacgtttttgaacaaacggtaatgctgaggattgctcaaaaaatgcttcacgatgggatgcttcattatctccttacattttgaccgtaaaagactttgatagtccatcaaaccgcctccctactaaattaaatgaaggaaagcaaaaaaaagtaaactactactttccgcctagtgtcttccaaaatactttgcagcagtttacgttttatcggttttcctcacttacatacatgactgcagaaaaagaagggaggtattttcctatggatcaggtttttatagaggaagtcgtaaaacagatcggcaatttggggtttcccgcgctgattgcaatgtatctgctgacccgattcgaaaagaagtttgatcaactaatagaactaatgacagaaatgaaagatcatgcaaaaaaataatttttcaatcgaagttgacttttcactggtttttttcacttaacaaaacagaagggaaaacgaaaggcctttcaccttctctttctgctatcacatttaaatgtaaggaggaaacatttcatgaaaaaacaaaatgacattccgcagccaattagaggagacaaaggagcaacggtaaaaatcccgcgcaatattgaaagagaccggcaaaaccctgatatgctcgttccgcctgaaaccgatcatggcaccgtcagcaatatgaagttttcgttctctgatactcataaccgattagaaaaaggcggatatgcccgtgaagtgacagtacgtgaattgccgatttcagaaaaccttgcatccgtaaatatgcggctgaagccaggcgccattcgcgagcttcactggcataaagaagcagaatgggcttatatgatttacggaagtgcaagagtcacaattgtagatgaaaaagggcgcagctttattgacgatgtaggtgaaggagacctttggtacttcccgtcaggcttgccgcactccatccaagcgctggatgagggagctgagttcctgctagtgtttgacgatggatcattctctgaaaacagcacgttccagctgacagattggctggcccacactccaaaagaagtcattgctgcgaacttcggcgtgacaaaagaagagatttccaatttgcctggcaaagaaaaatatatatttgaaaaccaacttcctggcagtttaaaagatgatattgtggaagggccgaatggcgaagtgccttatccatttacttaccgccttcttgaacaagagccgatcgaatctgagggaggaaaagtatacattgcagattcgacaaacttcaaagtgtctaaaaccatcgcatcagcgctcgtaacagtagaacccggcgccatgagagaactgcactggcacccgaatacccacgaatggcaatactacatctccggtaaagctagaatgaccgtttttgcatctgacggccatgccagaacgtttaattaccaagccggtgatgtcggatatgtaccatttgcaatgggtcattacgttgaaaacatcggggatgaaccgcttgtctttttagaaatcttcaaagacgaccattatgctgatgtatctttaaaccaatggcttgccatgcttcctgaaacatttgttcaagcgcaccttgacttgggcaaagactttactgatgtgctttcaaaagaaaagcacccagtagtgaaaaagaaatgcagtaaataaaagacttgcggcttgcagagagcactcgttctctgcaagccttcataaggagctgaaccagtgaaacatcaaaacccttcaaaacgcttattgcggctctccataaagtacttgctggccgcagcagcagtggtgttgacctattttgctgtcatctatatattgttttctttagcgggaacgagctaccgctcagcagctcatgtcctgctttttgccgtggtatttcttgttctcggattatgctttgaaccatttgaaaggctgatgatacatagctttacatttttcaagacaggaaaacgtctattcattctccttgccggcatcgtacagctgctatttttgtggatgactgctcatacaacagaccaattgatcagcgacatctggctgtccaccacagaagaaatgattgtcgcagccgtttttttgattttagacaaatgcaactcggctcttcccagctaaaaaaagaacgcattccaattggatgcgttctttttattcatagcgaagcgcgtctacaggctgaagcttcgaagccttgatagacggaagcaagccgaagataatgccgactgccattgaaaagatgagtgctccgacaacagctggaatggagacgataaaaggcatcggaaaaatgaccgtcagcagcttggcgatgccgaagcccgccagcacaccgagtattccgccaatgcttgtcagcacgacagcctcggttaaaaattgaaataaaatcacacgccgcttagcaccgagcgctttcttaattccgatttccctcgtgcgctccgttacggaaacgagcataatattcatgacgccgataccgcccaccaaaagtgaaatactggcgattccgccaagcagcaatgcaaatgactgattaaaggactccacttcctgcgcgatctcctgaagatccattacactgtactctgctttttccagctcagcttctgacagtccctgatttaaaagatctgcagccattacacccgcttcttggatatgctcagaagaatcagcctgcacggcaatctgtgttggcgcgtcaaacccttcaataagcggccacacttttttcggcacgtacaaaaccgggttcgcatagtcgccttcaaacatgctttcctgttgatttttttctttaaaaacaccgacgaccttaaacggcacaccattcatctcaatgtttttatgcagagcttctccgtctggaaacagttcatctctgacagcttcattgatcatcactacttggtgtgtgctgtttaaatcgttttccgtcagctttctcccttcggttattcggattggaaacatgtcgaagtaatcatcgtccactccatacacttggggatacgaaacgtttgttaaatgaaaaacgctcgcgccttctgacaagtaatataaggataatcctttgaccatcggatctgatttgatcgcctttactgtttcttccgctacaggcggcgcggacgcatacgacacctgagggccgccgctctcctcttctccgccagacggctggtagacaacgttgatcgcgttgtttcccatgccgatcatactttgctttaattgctcactttggcccttcagcattgaaacaatcgcgatgattgccgctatgccgataatcacgccgagcattgtcagaatcgatcttaatttatgagaaaaaatggattgaaaggagattcgaatatgttcaagcatggctgatatcccctctctcatctaataccagctctccgtctctgataaaaacggttctgtcagcttttttggcgacgtccgggtcgtgggttatcataataatggtcttgccttcccgatgcagttcagaaaacagtgacaaaatttgttcacttgatttggtatcaagcgccccggtcggttcatcagctaaaataaacctcggctgattgacaagggccctcgctatcgccacccgctgcttttggccgccggacagcttaggcggtttgtaggagaccctgtcttttaatccgaccttttccagcgcttcatatgcccgttgccttctctcttttttcttcactttattgtagatcatcggcagctcgacattttgcagcgcggtgagacgcggcagcaaatggaaagtttgaaacacaaacccgattgattcattgcgaatttcggctaaagccccgtctttccctttcaatatatcgatctggtcaagcgtataggttcctgaggttggcctgtccaaacagccgataatattcattagcgttgactttccagaaccggaaggccccataatagctaaaaactcccccgcctgaacagtcagattgatatgtttcaagattggaacttcttcttttcccagcttgtacgacttcgaaatattattcagtgtcagcattgactgtaacctgctttccttccttgaccgcgggatcaggatagatcacataatcttccggcgtcaggccgctcttaatttccaccatgtcattttcatcagtctctccgatttcaacaggctgcttaaccgctttgtgattctcatcagctttccatacgtacggttcgccgtcatcctgaatgaccatgtcggacggcagcttgatcgtgtccgcatcagcattatcactcatcacttcgatgttgacatgatagccgacttcaagacctttatggctgtctaataaaatggtgaaaggatagttagaggactggggattcatttcttcatcagcaaagctttctgattcttcaccctcgcctgctcccgctggaagcttgccgatcgaggtgacctttcctttccactcgccctcaccgcctgttttcagcgtgaccctgactttgctgccttttttgatcgtgtccattaacagctcattgatttggcttttgaccagatatttgcctgtcgaaacaatctggatatacgggcctgctgcctggtcgcctgttgcaccgtcagcgatatcctgattgacgctttgaacgattccgtcatgcttgcttgtaatgacattggaacctttgtttttcgtcaggccagccagttctttttgatgctgcttcagttcaagctggcttgttttcaaatcgaaattggcttggtcaagttcatcttgaagctgggttttctcttctttccctgcaactttcagcttcttttccgtttccgttattgatttttgcaaacggttgatttgcagatttgtcatttcaatttgcaaattggcttgctccacttcatcagaatgatcctcgccctcatactcaaaaagcttatcgccctttttaacctgatcgccttctttgacgtatgtttttttaatgctgcctttttctgaatctatgtatactttctgctgtttctcaggttcaacctttccagaaaacgtttggcctgattctgaatctcctcccatgtataccgcgaccgattcagcatagggctccgatgatacggcaacttggttcatgtgagtaaaaaagtaaaaaccgccagcgccgatcccagccaatacaagcacaccggcacatatcgcaccgccaataagccattttttcttcttggacacaacgatctcctctttctgtaaactatgtaatattttcgaaacattctaaccaatattatctattaattcaaaaagacttgcaatccttttattgaaatgacggaatcaaatagaaaaattgtattttccaagccgaataaaaaaaatcccggcttcaaaccgggattttttcatacagtaactagctctttttcatttttaatcaagtcatatgtcaagcatacaggtttatttgtacggggatcagtcacgatttcggcatcaatctgaaatacctgcttcaaaatgtctggtgtcatgacctccagagcagttccttccttgatgaccgtgccttttttgagcgcgatcatataatgagaaaaacgagctgcatggttaagatcatgaatgaccattaaaatcgtccgcccttgctctttgttgagtctgtcaagcagctgcagaatttcaagctgatgtgcaagatcaagatacgttgtaggttcatccagcagaagcagttccgtcccttgcgcaagcgccatggcaatccacacgcgttgacgctgtccgcctgacaatgcctcaatcggccgttcagcatattcagccatgcctgtttcttcaagcgcccatttgataatccgtcggtcttcgtcatttaatctgccgaatcctgattgatgcggaaacctgccgtacgacaccaattcgtgcactgttaggccgctcggcgcttcaggtgtctgtggaagaatcgccatatcttttgcaatgtcctttgtagacattttatgaatcgctttgccgtttaaatagacggcacctgcatgtgaacgcataattctggacattgtttttaaaatcgttgatttcccgcagccgttcgggccaattaaggtggtaattttccctttaggaatcgatatatttaaatcctctacaatcgccctgtcgccataaccgattccaagctgttccgttgataatgaattcatattcggccccctcctctaattcgctttcatcaataaataaataaagtaaggcgcacctagcacggaaatgacaagtccgaccggaatttctgatggtgccaatacatttctcgccagcgtatcagcaagcaaaaacaggaatgagccgatgaaggcggagaccggtatcagcgtctggtgacgtggaccggtcagccttctagccacatgcggcgcgatcaatccgagaaacgcaatgccccccgcagctgccacgcatgaagcggcaagagtaaccgctgccagaagaagaatccgtctttccttttcaacagcggtgcccagcccggtcgccaattggtctccgagctgcataatgttcaaatagcgtgccttatataaagtaaacagaagcaagatcacaatccaagggagaatcgcccagatcatattccagttcgccccccatattgagccggatatccaaaccgcggcttgcataaaatcatgagggtccatcttaagctgaaaaatcagcaacagggcattgaatccggcattcacccctatgccgactaaaatcagccgaatcggtgtcacgccttttttccatgccagaatataaatgagaaacgcagcgaggattgctcctgccaaagcactgaatggcagcataaatgttccgaaaaagctgagatctgaagctgacccttgaaaaaagtatataaaaagcactacagcaagtgaaccgccggcgttaattccgagaataccaggctcggcaagttcattttgagacacgctttgcaaaatggctccagctacggagatccctgctccaacaagcaaagaaaggatgatccgaggcagcctgaactcaaataagacaagttcatcacgcgccgttccttggccgaaaaagacctgaagcgttttaagcggtgcaattttgataacgcccaaattgagactgataaaaaagaccaccacgataagcaaaaaggtcacagccattacaataagcggtttgtttgtttttgttttcattacagccctctcctttcacgacgtgccaaataaaagaaaaagggaacgccgatcagagaagttagcgcaccgacaggcgtttcaaagggcgcatttacgagtctggccgctatgtcagcaaaaacaagcaaaacagcaccgagcaccgccgagcaaggaatgatccaccgataatccacaccgaccaaaaaacgggtaatatgcggaatgatcagcccgataaatgcaatggtgccggcaatggaaaccgcagctccggtcagaattactacaataagcatgcccaccagtttcactgctgatgtatattgtccaagccctttcgccagatcgtcaccgagacttaacactgtcacagatcgggcgataaaaaacgcgagcgttaaaccgacagcccctgcaataagcaaaagctggacccccgaccatttcacacccgctaccccgccagcgtaccaaaagctgatatcctgagcgacatcaaagcggattgcaatggcagttgaaatgccggtaaagaaataagtaactgccgtacccgccagagcaagctttacaggcgtaagtccgccccttgaaaacaagccgatgcccattaccgtcgatgcccccagccccgctcccgcaaaggaccatagcacaagccccattgcagaaagtccgggaaaaaaggcaaacgcaatcgaaaccgcaaacgcagagcctgatgtcacacccataatcgaaggctctgccaaagggtttctcgtcatcccctgcatgattgctcccgacactgccaacaatgcgcctacaagcgcggcagccgccgttctcggaagccgaagatcatgtataatttggtgagatgtctttgtcggctgataatgaaaaatggcgtcccatacagtgcgcaaatgaatatccgctgcaccgagggatatggataaaaatgcgccaaggcaaagcaggcatagacctgcaataaggacgatgaccgcgccatatgtccttgacgtccattggatttcttctgatgcagtccgtatatttttatgttgactcaactgccgtacttcctttctgttactgataatgattatcaattgctgtttcagtatatcacttttttcagctgatttaatagagtgttttgaacaaaaatgaaaatgcatttgcaaaaatatcgtgtcaaccggcacttgcagtggtataatcacagatgataatgattctctttttcatctattttttagaaagaaggtatgagatatgacccatatatacaagaaactcggagccgcgttttttgccctgttattgattgcagcgctggcagcctgcgggaataactcagaaagcaaaggttctgcctctgattcaaaaggcgcagaaacctttacatacaaggctgaaaacggaaatgtaaaaatcccgaagcatcctaaacgggtggttgtcatggcagacggctattacggctacttcaaaacactcggcatcaacgttgtcggtgcgcctgagaatgtatttaaaaacccttactacaaaggaaaaaccgacggcgttgaaaacatcggagacggcacttcggttgaaaaggtcattgatttgaaccctgacctgattatcgtctggacaacacagggcgctgatattaaaaagcttgaaaaaattgcgccgactgtcgcagtaaaatacgataagctcgacaacatcgaacagctgaaagaatttgcaaaaatgacgggaactgaagataaagctgaaaaatggctggccaagtgggataaaaaagttgcggccgctaaaacaaaaatcaaaaaagcggtcggtgacaaaaccatttccattatgcaaacgaacggaaaagacatttacgtattcggtaaagactttggaagaggcggaagcatcatttacaaagaccttggcctgcaggctacaaagctgacaaaagaaaaagccattgaccaggggccaggttatacaagtatttcattagagaagctccctgactttgccggggattacattttcgcgggcccatggcaatcaggcggtgatgatggcggcgtttttgaaagctccatttggaagaacctgaatgccgttaaaaatggccatgtctacaagatggatccgatcggtttctatttctctgacccgatttcattagaaggacaactgaagtttattacggaaagcttgactaaataaacaaaagagccgcctgcccgcggctcttttgcaaatttataaggaacagctcaatttgaatcatatcagatattttctttgagccattcatattaagctgcatcctcatcgcgatcagtttttttatgctggagagactgaaaaacgttttttgcatattcgattgtgccttaaagtttttctttcgatttcagctttcctgtcagctaggttaacgaacggattcttaacagaagaaattgtgattttataaaaaagacacctgagcaaatcaggtgtcttttcattatgcttgtttttctttctggaactttttactcacaaatgtataaacgattaagccgacaaagaataaaccgatgccgaggataaatgtcgttaaatctgctgtgcctgttacgataacaaacacggagtatgcacacgccagtatcgcgatcaatccgtctcttacacgggagcctttcagctggtcatacgtttcacctttgatgactaccttcaagctgtagattgcagataccagatacggaattaaatatgcgagtgtagccgctgtcgttaaaaatgtaaatgcgtcacttattgtccgggaaataaccgagaaaatgaagacctgtgacatgacgtttgtaataatgagtgcaatgaccggacttccctttttattcgtttttgcaaaaaatgccgggaaatctcctgctttagcggcttggtatggcacctcagagccaagcaaaatccagccgagcatcgttccgaataaacaaaggatagccaaaagcgccataatcacgcttcccgcgtttccaacaatcgcatagagtacatcaacaaatggtttttcagagccgacaagcttatcatgcggcagaacacccatcgtaattaaagtcacaataatatatatgctcaaggcaatcagcaagccggtaattgtcgcacgtttcacatcacgctgagagcgcgcacggccggacaggatcaccgcggattcaattccgacaaacgcccacagtgtagaaatcgcggcgttatgaacctggccgccaattccaatgcttgtgccgttttctccttgaaccgggaaataaaaatgaccgaataatgtcgtttgaaacacaaacaaaccggcaacgataaagaagacaaaacctaatactttagaaagcgttgtgacaaagtttaatttacttgcgccgttaatgctggcaacaagaatcgcgtgcgttccccataacaagatcgtacatacggcaaacgtcagtaattggccgagtgtcacctcttgcccgccgatcgaaaacatctcacgtttatcaaccaagatcgggaagaacgaagtcaagtaaccggcgagacttgtgatgatcgccacgttgctgatccagctcgccacccagtagccccacaccattgtgaaaccggcagcgttgccttttttcgggtcagaaaacagcgctcttgcataactttgcggtcccgctgtcagttcaggcttgcgaatggacaagtgtccgaacacaagtgcaatcatcagcacgccggcacctgtcaaaagccaggcggacgtagctccaaacggactcgcaattgaagcaagcgagctcggcaaggagaaaattcctgatccaaccatatttccaacgacaaacgccgttaataaccaaaaaccccatttttttgtctgttccattccagtacctccatgattctttgtacggaccagaccccgagatcatataaacgcaaaaaaagcctgaacaaaagtccatgcttaaagaaacacacacccttgatctccggatagccctccgcgaaaaagcacgcggcagtcctgcacttattcagatacagtcccagcatagagaaggatcggctttctccacacttcggcgctgatgccttttacacatgtttaacagcccctgtcagcctggcatgtgtgacttatcatccgcgcaacctctacctcactgagaaagagtgaggatttaattattcagttactcccagaaggttatcaaagaaaggatgatctgtcaaagggaacagatggaaaatacggatagagccaagccctatccgcatgtgattatcgattatttttctttttttgcacagcttcttgaagcggatcatcttttagagctgaaccagcatcttcaagagctccttggattacgtttttttctttttcggaacgttttcctttatctttattaaagaaacccattcgtatcacctcttttaaaaaataggtacatgtttaagatgcctcttttatgaaaaattatgcgggatattttttatcgtccaaagtcctgttgatcaaacatacattctcttgatatatttgtaattcagagattttttgcaaaagataaaaggagaagcggcaaatgacaggaaaaacacacatcatgggaggcatcgcttcttgtacggcagcggcttattattatggatttgatccagtgcttatggctgcgtcaggcgcggttggagcattaatacccgatatctgccacacacaaagcaaaatcgggagaaaatttcctattttatcgaaagtggtcagctccgtttttggccatcgtacatttacacacagcttgctgtttatgctcatcatgttttttatcacttctacatacattccagataaaaacatatcagccggcctgatgatcggaatggcaagccacttgattcttgacgcttggacggtaaacggaatcaaattattattcccttcaacgatccgcgttcggcttccattatatatgaagacaggcagtttttctgagcagctcgtgctagctggcctgacccttgcttcatgttactacttttatatgctgtttcatgggcgcatgttttaaacatgagtgctgagacttgtctgaaccggctgtttttagtaggttttacttaagaagcatttcatgcagatgatcaagaaaacgcgaggagtcatattgatgaaaggaaccttttttcacaatcagcggtttttatgtttttcgatcttatttatgtggatcaaaacgtatgtgatatataaactcggctttgatttgcaaatcgatactctgttggaggagctaatgctgctggtcaacccgctcagctttattcttcctttattcgggatcggcctgtttctaaaagaaaacaagcagcgggcctttttgctgatcgccaatttggttctgactgttatcttgatctctaatacgattttttacggcttttatatcgattttattaccatcccggttttatttcaggccagcaacatgagcgatatgggcagcagtgtaaaagaactgttccatcctctgtttatcgccctgtttgtggatttggtttttctgctgctgttcgccagaaaaaccaaacacccacagacaaaagccgctccccgcacgatcaaacggtactatgcagcttcctgcggcatgcttttatgcacactggcacttgcagaagtacagcagccgaagcttttggcacattcttttgaccgggaaatgctagtcaaaagcatcggtctgtttcagttccatatttacgatacaatttctcagactgttaatatcagcgcgaaagcttttgccgatgaagacagtataactgccattaaaaactacacagaggctgattacagcaagcctgatcaaagcaaattcggtcttgcaaaggggcgcaatgtcatctttgtaacacttgaatcgacccaaagctttgttctgaatgaaaaagtaaatggaaaagaaattaccccatttatgaatgatctcataaaaaaaagctattcctttgatcatttctatcagcaaacagaacaaggaaaaacatcagattcagaatttatcgtcgctaactcactgtatccttcccttagcggcgccgtctttttcacgaaaagcgaccatcaatttcatacgatgtataaatcgctgaaacagcacgattattattcagccgtctttcatgctaaccataaaacattttggaacagagatgtcatgtacgatacgtttggcattgaccgcttttttgatgttgatgattttcatgtcactcccgggacatcgacaagctggggcttaaaagacaaagaatttttagagcagtccgccgaaaagctgaaaagcctgccacagccgttctacagcagttttatcacgttaacgaatcattttccgtttgagattgatgaaaaggatcagctgatagatgaattcgattcaagcagtgatctgttaaaccgctatgtgaccacggttcgctatgaggatgaagcattgaggcattttatcaaaaaactgaaagacgaaggcttatacgaaaattcgatgatcgtatttatgggagatcattacggcatttctgaagcccataacgaggcaatggctgagtttttagggaaagacgaaatcacaccgtatgacaacgttcagctccagcgggtgccgtttatcatacatatcccgggaatcaccgatcaaaagccggaaaccatccctgatgccgggggacaggtcgacgtcaggccgacgctgatgcatttgctcggcgttgagacaaaaggcgatatccaattcggcaatgatttgctgtcgggcgaccgcaccccattcgccgttctgcgaaacggcagctttattacgaacgattatatatacacaaagaacacgtgctatagccaaaaaacaggtgaagtgctggaagatcaggatgcgtgcctcccttataaggagaaagcaaacgaagaactgtctttctctgataaaattttaaatggtgacctgctcaggttttccgaatgaaaaaaatccctctatcaagagggattttttacgtttccaatatcaccttgccagtcagcttcgtttcatagccgtttaattgagacaaattcgccttgtattcctcagaattcaaaatctccttcacggccttaagcagctgctcatgttttttcaaaacgacaatatcatattgttcgtcgatgagcgggataaaatcaacactgcccatatgtgccgcgtgctgtgccccgattcccgcgtcagcctgtccgcttgaaacttgtgaagcggcagcgtaatgatcggtcacgatatcgtcgtatccctttacatcagccggattcacaccaagcaagccaagctgttcatcaaggagcacccttgcgccagaacccttttccctgttgatgatccggatatcggctcttttcaagtctttccagccttgaatgtttttcggattccctttttgcacatacagtcctgctttccggagaacgacattgatgagacaaaacggttcacctgtcaagatccgtttcacataaggagcgttatactggcccgtttcagcatcgtacaaatggaggctgacaatgtcacacttgccttgatacatatcaatcaggctgtttaagcttcctttgtatttacggagcggcgtctcttgaatggcattctccaaatgcttgctgagaagatccatcgaaatgtcctgtccgctgatcatgacattcggtctgccgtccggctcagcctcctgcacctgtttcggtgcttctgttgcagcgatgggctgagacattctcatattcgttttatattgctttaaatcttcttcatccacacgcatctgccttccgacacgataagcaggcagcacgccttttttaatcaagtcataaacggtcagctttgataccttcagcagacctgcaacttcttctatcgtataggaagaggtttcattcatcatcatcactctcctattttattataccttttcgttgaatgtaaaaaaacccacataaaccaaacataatcagttataattagttatatctaatgataaggggtgcaatcatgtttaagaagtattctattttcatcgcagccttaaccgcttttctgcttgcagcaggctgttcttcaaaccagtcttcaacggacagcgagaaaaaagtaacgttaactatctcagctgccgccagcgcgcaggatgcacttgaggaaatccaaaaaaattatgaaaaagagcatcaaagtattaccatccaagataactatggctcatccggcgccttgcaaaaacagatttctcaaggagcaggagcagatctgttcttctcagctgctgaggataaatttaaaaagctggtggatgatggagatatcgcaaaaaaagacagcactgatttagtcggtaatgaaattgtgctggtcgtaccgaaaaacggagattcacctgtgacaagcttcagcaatctggctgaatcagaaaaaatcgctctcggcacgccggaatccgtaccggcaggagcttatgggaaagaatcactgacaaagctgtctctatgggacaaagtgaaggataaaattgtgtatggaaaagacgttcgccaagttctttcttatgttgaaactggcaatgtagacgcaggtattgtttataaaacagatgccctggtctcgaaaaaggtcaacattatcgacgaggcaaaagcagatacacacagcccaattatctatccgttaggaatcgtaaaagatacaaaacaccgtaaggaagcgaaggaattttacgaatacctgcaatctgatgaagcaatgaaagtatttgagaaatatggctttactgccaagtagcataagcgcttcagaatttttcacacccgttgtgctttcctttcaggtggcggcagttgccggaattgttgtcattattctcggaacacttgctggagcatggatgtcacgggcatcatttttcggaaaaacggcactcgaaacatgttttatgcttccgctcgttcttccgcctactgttgtcggttttattttgatcgtcattttcggaaagcacagcttcatcggacaagccatcgagtggattttccagcagcctgtcattttcacctggtgggccgctgtgatcgcctcggctgttgtagcctttccgcttatgtatcaatcagccaaaaccggatttgctgacattgatcccgatatacaaggtgcggcaatggtagacggcgctagcagatggaaagtgtttatccatatctccgtcccgcttgcctatccttcgttactgaccggaagcatcctcagccttgcgcgggcgctcggagaatttggcgcaacactcatgtttgcaggaaacatccccggtgttacgcaaacactgccgacggcgatatatgtcgcattggattccggcaacaatacccttgcttgggcgtgggtcgtctgtattgttgtcatttcctttttgatgctgtttttcattcaacagaaaaaaacgcactaaaaaaactccccataacagggagttttttgattaaaacagaagctcatcaggatttgggccgacacgctcatctttatttaatgcgtcaattttgtccatgtcttcttgagacaattcgaaatcaaaaatatcagcgttttcgatgatacggtgttctttaatggattttggaatggttacaacttcatgctgcagatcccagcgcaaaatcacttgagccacagatttattgtgtttttcagcaatctgtgtcagtacttcgttatccaaaagctgtccctgcatgagcggagaccacgcttccagctgaatgccttgcgctttgcagtaatctcttaattctttttgcgtcaagcgagggtgaaactcaacttggttcaccatcggtttgatttcagcatctttcaacagctcttctaaatgatgaacttggaagttgctgacgccgatcgcgcggattttgccgtctttgtacagcttttcaagcgcgcgccatgtatctttatatttatctttgccaggccagtggatcaaatataaatctaagtaatcaagctgcaatctttccagactcttttcaaaggcagcaagcgttgtttcgtagccttgatcttcattccacacttttgatgtgatgaagagctcttctcttgccacaccggattctttaatcccgatgccaacgccttcttcatttttgtagatcgctgctgtatcaatgctgcgatagccatttttaattgccgctttcactgattcagtcgcttcattaccattttctactttaaaaacacccagaccgaaccaaggcatttcaactccgttatgtaactttacagtatcttttaaacttgttggcacttgaacatccaccctttcactgaaatgtaagcgtctatattatctcacattcctctcagccgataccaataatacgcttaagaccctctttttgcttcttttttcacagcacaggcaaatccaaacactatttttttcctattttaacaatattgagattacaaatacattgagcagggtatgcgtgtagtgtaaccaaatgaaaacaaaggaggaaacaacttgaaacgtattcgtatcccaatgacacttgctcttggtgccgctttgacaattgcccctttgtcctttgcttccgctgaagaaaatcctgctccgaagatgtcgcagacaactgctgctggaacaactgccgctgatgtaggtttaaacgtcaatctggatgtacttggaattgccaaccagatcgctgatgccatcaaatccgcacagaacagggatgggtttgtgaaaaacctcatggagtcttccttctacgcatccggccaaaaatataatgtcatggtctttaatttaagccaggaatatgaagatcatttgaacggtgtgcaattttacggctcagccgtttacgacggcattacgtatggcatttgggtatttgaagatggaacctttacaaacaaaggcgatggcggctggatcaactgggccttcagaggctggttcgaccgggatggcagcactgtcgcatttcatcgcccttaatatagaaaaaagctggcgctctaacgccagcttttttgctgcatttattcgccgccttcaagcatggcggcttcgacatcattaatgtattggcgaagctcatgggagatgtcccgggaaatttctctttcctcgaaaagtgtttgaatttcatttctgatcgcctgtacagccttcagcttcacttccagcttctgattttcaaaatgggcgcttgatttcagctcatgatggctgtgctccagcctgaaaattaactgtttatagaatgtaatgacagataaaaacacttctttatgctcttccgtcttgtgtttttccagatattctatcgctgcttttgccgttttcactcttgttgcccgtatcaatcccgcttcatttaaaatcgacatctccggctttttatgttcaccgaagaaaatccaatacatcagcctcttgagccttgtttttgataatccgactttaaacgggttcgcatacaaaatttccaactcgttaaatcgttcttgcagcacatttgctgtttcttccgggatgtctccccgctccagcattttcatcagcgcctcttgctctgccttaaccccttgggcacggactttacgctcgtgctttttgatgcgattagacgatgtatattgctgaaaacgaagatttttcattttctcattgtattcagctatcaccgcaagcgaggccgttttgtttgtctcattcatgtcctctttaatcgtttgaagggctgttttgatcaatttgcgtctcgccgtcagcagcttcttgtttcgttcctcgtcctcttcttctttttcagtcagaatcggcagcacaacggtagcaatgacaagcgtgcataaaatgacgccggctgctaaaaagagaatcagatttctttccggaaacggcgtgccgtcctccaggaaatacggaatggaaaaagaacctgcaagcgttactgctccacgcacaccggaaatcgaaattaacagcgtcgaacgaagacccggtttatagatgttctgatctttattaaagaaccatttgccgttccagaagaacagcacccacaggaatctcaggagcattaacgtaaatgtgatgactaggatatagccgatcaccttcatgttgctgatggcagtgtcgttaaagataacagaaataacatcagggatttgcgtgccgagaataacgaagaccagaccgttcaaaataaataaaataatgttccacgtacttgaggagacaatttgcagcttgatcatcgttgattccagacgatcctgttcaaccgcatgggtaataccgccagccacaacagctaaaatgccggaaacgccgatttcttcagctgccaaataaatcacaaacggcgtcagaatttgaatcagcatatgcatcgtgacatcctgcatgccaaggcggcgcagaaataggcgaaaacgaataatcaaaaatgaaatgacaaccccgcacagcaagcctccgagagaaataaagacaaagctgacagccgcttgtgctaatgaaaatgcgccagtcactgccgctgcaatcgcaaacttaaaggccaccagacctgatgcgtcattcatcagcccctcaccttccagcaggcgaagaatcccttttggcattttcactcttcctgataatgcgctgacagcgacgacatcagtcggtgaaagaatggccgcaagtccaaaggccgctgccagcggaatagcaggaatcatccagtgaatcgtgtagccgcctacaatcacagtcgcaaatacaaggccgagtgcaagcaataaaatcggagcccttaaattccaaagctctgcccgcggtgtcctctttccatcattaaatagcagaggcgcgataaaaagaacaaaaaacaattcggtgtttaattcaaaatgaagtccctgtggaaatgaggcggcaagaatcccaagagccacttgaatcagcggcaccggaataaacggaataaaccggttcacgatattagaaatcgcaataatcgttaataatacgagcacaactaaaaatatgtccaaatgcatgacctccttcgtctgttgtgtgtcggcatgatgagccaaaaaatctgtttgtctaaaagcccttgagctagggtggccttgcatccgctatgtggttccgcaggagttctctccacacttgtcttcttttatagtaccctttttagggtattttttctcatgatatgctcacagtgaacttttttgcagcagagcaaattacagaaaaaagagacaggaagctactccctgtctctcgtctttctttctcaatcatgaaaattcgtaccgtcagttgttgctttgataatgcccgcgcggatgacaaagtcaccgaaatgctcgccttcctcacgttctttcgcatagcgggaaagaaggatgcgcagctcgcttaaaatgtctgcttcaccgatgttttcacggtacattttgcttaaacggcttccgtcaaacgcagcgccaagatacatattatatttgcccggcgcctttccgataaatccgatctcaccgagtgcatgacgtgcacagccgttcggacaccctgtcatgcgaatggtgatttcctgatcacgaaggccgttttcgtcaataatctcttcaatcttatctaacagggtcggcaaataacgttctgcttcggccattgccaatccgcaggtcggaagagcgacgcatgccatcgagctgcggcgaagtgctgaatagtgcttgccgtcagttagtccgtactgttcaattaaagcactgatttcttcttttttatcgcttgaaacgttcgcaatcattaagttctgattggctgtcagccggaactcacctgtatgaactttggcgatttcccgcaagccagtcatcagcttataatcatcgtaatccgttatacggccgccttcgacaaacagcgtgaaatgccatttatcctcgatgccttccacccagccatagcggtcgccgttatgatcgaaatgatacggcttcgcttcttccaggctccagccgagacggttttccaattcttcttttacgttttctaaaccgaggcggtcaactgtgtatttgaaccgcgcatttttacggacagaacggttgccgtaatcacgctgaatcgtaatcgttttttcagcaacgtcatacatttgctcaggccggcagaatccgatcaccttggctaattgcggatatgtcgcagtatcgccatgcgtcattcccataccgccgccgattgccacgttaaaaccgatcagcttgccatcctcgacaatcgcaatgaatccgagatcttgtgaaaagacgtcaatatcattagacggcggaacggcaataccgattttaaacttccgcggcagatagagcggtccgtacattggctcgacttcttcctccggcgtgccggcaactctttcctcatcaagccaaatttcatgatatgctctcgtccgcggcagcagatcatcacttaattttttagaccactcgtatacctctgagtggatttcagattgataagggtttgatgcacacatgacgttacggtttacgtctccgcaggctgcgatcgtatccaaaagtgctgagtggatcgtctgaatggttttcttcatgttccatttcagaatcccgtgcatttggaacgtttcacgtgtcgtcaattttaatgtgccgttcccgtatttctgggacaggtcatccatgacaagccattgttcaggcgtcgagacgcccccgggcatacgcacgcgcagcatgaactgatatgcgggctcaagcttctgcttttggcgttcatttcggaggtcgcggtcatcctgcaaataactgccgtggtgtttcatcaggcggttatcatcatccggaattcccgcactgattcgatcgagcatcacttctttcagcgtgccgcgcaaataatcactttcttttttaatgcgttcaacatcacttggagagccgtccggtgcttttagaattttggtcaccatgttgaaaaactcctttcaagtcaaatcaatatacatcacgctgatagcgtttttgctgctgcatatcggcaagataagcctccgcttcttcgcggctcatattgccttctttttcgataatttcaagcaatgtgttatggacgtcatgcgccatgtgcttttcatctccgcaaatgtaaacagccgctccttcttgaagccattcaaacaattctgcgctatgttcaagcatgcggtgctgcacatatactttttcttccgtatcacgtgagaacgccacatccatttttgtcagcacaccgtctttgagccaattctgccactctgtctggtaaaggaaatccgtgacaaagtgctgatcgccaaagaacatccatgcctttccttccgctcccgtctcctcacgctcctgcataaaggaacggaaaggtgcgacgcctgtcccagggcccaccatgataatcggtgtttcagggtctttcggaagcttaaagttttgattgtgctgtacataaaccggcagtgtgtctcccggctgcagacgttccgcgcacaaaatcgagcagacgccttttcgttcacggccgtgcgcatcgtagcggactgcgccgattgttaaatgcacttcatccggatttgcggataaactgcttgcaatcgaataaaggcgggcaggcatttttcgcaaaatcgagacaaactcctgcgcagatacactaaatgggccatagtcacggacgagatcaagcaaatcgcgcccttcaatataggcttttacattctcctcatttcccggggctaaaagctctctaagctcatcgttccctgtcagctgggctgcctgttcaagaagcggttttgtgagaacggtaatctcatagtgagaaatcagcgcttctttcagcggacggacatcaccttgcttattaagcgtcacaatttcttccgggtcccaattcatttccttaaggagcagctcgacaagttccggatcgttttctggatagacgccgaggctgtcaccaggctcgtaagtcaggcctgatccttcaagagacagctccacatggcgtgtttctttatttgatcctctgccgtttaaatttaaattttctaacacttcagcccgaaacgggtttgttctggaatacgaagactcaccggtttgtgacgcagccgccggcgcaggcgcggcggttccgcccccagcttcatttaatcccttcaatacaccctcaagccattcggctgccggttcatcatagtcaagatcgcaatcaacgcgcggagaaatccgttttccgccgagttcttctaagcgctgatcaaattctttccctgtctggcagaaaaattcgtacgaactgtcaccaagcgccaaaacggaaaagcgcaggtcttcaagcttaggcgcccgtcttccgtgcagaaattcatgaaacgacagcgcgttatcaggcggctcgccttctccatgcgtactgacgacgattaaaagattggttaccttcttcagctgattcggcttaaaatcgctcatggatgagacggtcacttgaaaaccgctctgttcaagctgcttgccggcattttccgcaagcccctgtgcgtttcccgtctgtgaaccataaagaacggtcacttcttttgaaacggccggtgcttccgcagacacagctgccgccggcgcacccgcagtttcttgggcggaaacagattgcgcggataagtatccgctcagccagattttctgggattcggtcaaggtcggcagaaggcggttaaggagctctgcctgctcctgattaaacggactgttcattacctgaagttgcaacgtatccacctcacaaagttataaactgatcgaaaattgcatctaattgaactttaccggaatactaggcttaagtaaaatatatttacatgatgataactattaagaatcctaatgataaaacggctatgcttcatgtaaatagaaaaaagagaaggactcccttctcttcattcagccatctgatataagtgaggcggcacagcggttacaaacggactggcttcacctgtataaaatactgccagcatgtgcatcgcacgggtgcacgcagtatataaaagcctgcggtcgtgctctgtatgatagtgttcttcagatgcatcatagacaagcactgcgtcaaattcaattcccttcgctaaatacaccggaatcacgcaaacacccttttgaaatggttgattttctttatgaatcaggcgaacatctgtatattcactcatgtgggcgtgcgcctgtatgcattgctgcgcagtcttgcagatgacggctattgtttcgcgcccttttttcttgagccggccaatttcttgcgcgagcttttggcaaaggctctcatgtccttcagttttgacaacgagcggcatttccccgcttctattaaacggctcaatatccgctccatattgaagcatcgctttggtaaactcgacaatctgccttgttgatctgtatgttctctttaaacgaacatactcagcaggctcatcctcaaagcacgcatccatacgctgatccccgtgtatggtatgcgcgtagatggactgattgatatcaccgagcactgtcatgctggcagccggaaaaatgcttctcatgtaaaccatctgaaacggtgaatagtcctgagcttcgtcaataaatagatgtttgatcttcgtatttttctttctgccctcaatcagatcctgcatataaagaaacggtgctgcgtcctcatagagcaatttattatccgtaaatgccgaactggtcagctcacctatcgcgtccatcttctcatgctgaaattttcctccccagccagaaaacaattgcaaataaagttgtgtaacatcaagaaatgcaaggagtctgaccgcctgtttgagcggtttgaaagcttttttcacaatgatggcggcaagcagctgctgctctctttgataatcgttaaacgtactctcgctgaaccgtttcctttcttgcagttttctgtacacgtccaagtagtcctctttgtcaagcagctcagcttcatgaacaacccaatcctttcgccgttcctttttctcaagcttgttaagctcactcagcagccacttcgcggtttgctccatccgattcggaatggagtgattttgatccaatgagtaaaaataggattgaatttgctcctttgtgatcagcttttgtccgcggaatataatatttttaaaaatcatcccttcagaggaaagccgtgtgacgtattcattaatgaattgctgaaaggataaacccgccttccatgtgattcccgcaagccttgttggaaaatcgccttccttagtttcggtcaggcaatattcgagctgatcaaaggcgctttcacatttgaacttgcggccaagacgatgctcgatatattcctgaaacgtcgcctgctccatattctcttctcctaactcaggcaaaacagaggatacatagctgttaaataagaagttgggagaaaacaaaacgatttgtccggcatcaatgacgccgcggtgcctgtataacaaataagcgacacgctgaagcgcagccgatgttttcccgctgccagccgctccctgcacgatcaggatcttgcttttttcattacggataatctgattttgttctttctgaatcgtagacacgatgtttttcatttgggtatcggagtgatggcttaatacctcttgcagcatttcatcgccaatcgtcatatcggtattaaacatcgccttgagagtgccgtttttgatcataaactggcgtttcagcaccatttccccttctatcgtttcaccgggcacctcgtactccgcttttcctggagaataattgtagtacaaacttgatatcggcgccctccagtcatagatcagaaagtgttcctctttctcatccaaacaggaagctaaaccgatataaattcgctctgcctccgcctcgccgttttcaataaaatcaatccggccgaaataaggcgattttttcaattgatgaattcgtttgagctgctgatccatgcgccgatgattctgttcccgatcagacagcagctctgcctgctgcttaatgcttgccatcgtttcaatcgcttcatgggcatcatcaaaattaaccttaacatcctcccaaaagctttttcttaatccgatgatatcatgcttcaacccgcccgcagacgtttccagaaaccgctcttttttttcgagctccttcagcacctcatctattctcgactgctcttccttccattccttatcctgctgattcatgaacggcacctccagaaaatagttgacaaacatagatgaaatactgtaaaatataattggatacatatattaaatatatgatgtaaactggcaaatacaatttataatagcacattcacccaataccaatcaaggtttgggttatttatatgcagaaaaaaccgatttcaactcgaaatcggttttttctcttatgatttcacattgatcactgttggacgtgcttttcttaggttgcgaatcttctctttcatcagtatcgattccttattcctttcaatcttcgatataatatatctttttcattttaaaaacaccgcagagctttaccgtatttgtctgttcatctaacgtgaagaatgactaaactggctgttattgtcatcttccataaagcaactacatctctgctatcgtatctatagtcgcagtaaaatagtcatttttcacccattttcgacacatttcaacaaattaaagtttttcatttgggagaataggacgatgttacattatttctctcggtttatgatatgaacatgaagaaagaaccagaattagttaggaggaaatactcagtgaagaaaaagctatctatgttgttgctggcattcgtcgtagccgtaacaagttttacgtcaattgacctagtaaacaacaaagcggaagctaaagattgggttaaaaaaggtcaaatatggagtactcattaccattcgggctcatttaaaaactatacttactcgccaacttttcatatttattatccaggacgaggaacttgggccaacatgacatcaaatggatcaggcagcgggaaaattacagcaactctgcaacaaaagacaaataaaggctggaaaaatgttaaaactttttacgcaacgaaaaaaggctctacaaatttaagttacaaacaagcttctaaaagctacaaaacaaaatacagattcaaattcactaacacaggaactaaaaaaaccatcagctataccttttgggctacctattaatttcaaatagctttgctctgcgcggtcagcattcgaaaaggactttttatttgatcccggcaggctaccataaaagaaacctctccgtcatggagaggtttcttttattttactgactatctaagcgaaaagaacggtttggcagcttccaattaaacatataggaacaaacccggcaaacaacgagcacgaaaaacagaacgtataagccgaacgagttccccatccagcccaagccgacgattaaaccgccgagagccgcccagactgcataaatttctgccttcagcacaagcggtttgcgaccggcaagaaggtcgcggatgattccgcccccgcttcccgtcagcaccgcagccacgatcacggcactaagcggatggcccattttgacagcatacagtgcgccttggatagcaaaggcagcgaggccgatcgcatctgataaattgccccacttattccaatgcttcagcagcagcttcggaaacagaaacacaattgtaatagataaaagcgcgatttgaaagtacgctccctgctcccatagcgctgacaccggaacaccgatcagcaaattgcggatcgctcctcctccaaaagctgtgacaatccctaatatataaactcctaaaatatcatattcctcttccatcgcaacaattgcgccgctgactgcaaacgcaatgatgccaatcacactaagcagctcccaagccattctgatgactcccttttatgtttgttaaattttctgacgacctctagattttataatcgctccagcgtaaaatcaataacatttttatgagaaaaaaagataaatttagagggaatacggctattgctgatggacatgagtttgcgaaattaaaaaagcgcccggcatacgcgggcgctttttttgttattcagatttttcgcctttcagcaggcacataaaaatgataatcaggataaaagcaatcagggccaggaatggaatcgtaataaaaccaaaccagttaatatattggcccgagcacggcacgccgcttacacacggcttaatgccgctaaaaccgggcactttttgttctaagtaatgcatggttgaaatgaatgcccctataatcgccatcgggagcacatattttttcactcgtgtgtccccttgaaaggtggcgatgcctaaaatcagaacgagcggatacatgaggatacgctggtaccagcacagttcacatggaataaactttctgatttcactgaaatacaggctgcccagcatagcgataagagccacaacccaggaagcatataaaaatacgattctatttttcatatcgttacttccctttcagctctttttctattgtctctttgatttcatcataatccgcaaaatttttgatcactttatcattgacgtaaattgtcggtgttgcctgtatgttcattttttgattaaggtcagaatccttttccacttgagaagcgaatgtttccttatcaagattttccttgagcgtctcaggttttatctttgtggtgctttttgcaagatcaccaaggaggcctggggttacccattcctgttccgtatccggctgtttttcgaacagcttttcatggaaatcccagaaagagtcagggtcttccttccatacttcttcagatgcaagagccgctaatcttgaaccttttccatggaacatgacgttcacgaaagaaaatttcacatcgcccttatcaataaagtctttttgtatttttggaaagatgtcactgttaaacaccttgcaagacggacatttgtaatctccgaattctactacagttaccggtgcatcgtccttgccaagcacaggctgccctttgatagacggctgtccggaaaccgcatcattgccttgttccgttttgttattaatgatgacaatggctgctagcaatacaacaaccacaaccgtaaggatgaccgcgaatttcgcagaagactgctgtttctttttcactccgacacctcatcgttttaaaattaaaaaagaagcggatcgcaattgatccacttctttattttaacaagacaagcgccgataagaaaaccccgaaaaaatgaattctctccgacaatttatttgtttttgagacgcatgacgcgcatagcgtttgccacagcgagcagtgtaacaccgacatctgagaaaaccgcttcccacatggttgcaattccaaatgctccaagaatgagaaagatcgctttcacacctaaagcaaagccgatgttttgccacacgattcgccgtgtccgtttcgcaatccgaatcgcttctgctatttttgacggctgatctgtcatcagcacgatgtctgcggcttctaccgcggcgtctgacccaaggcctcccatcgcaacccctatatctgcgcgtgcaagcaccggcgtatcattgatgccgtcaccgacaaaaatgagtttttcactaggcaaaagcttagcttctaatgcttcgacctgcgccactttatcttgcggcagcagctctgcatatacctcaccaatcccaagctgttttccgacggcttctcccgtttgtttcgaatcacccgtcagcatagctgtctgtttgatcccaagcgactttagatcagcaaccgcctgtgctgcgtcttcctttacttcatccgctatgatgattgctccggcatagcgttgatcaacagcaacgtgtacgattgttccagcattttcatccgggacatcctcaatttgttctctttccatgagctttttattcccggcaaggatctcagttccatttacctttgcaaaaatgccgtggccggggatttcttcgtatgactctatctcatcggaggaaagcattttcccgtaagctttacgcacagattcagcaatcggatgctgtgaatgaagctcagcgtatgccgccgcttcaagtaatctatcctttgtaaaaccttccgcgggtttgatttctgtcacttcaaagctgccttttgttagtgttcccgttttatcaaacaccgcgtatttgacttgattcaaagcttctaaataattgcttccctttacaagcactccggcctttgaggccgctccgattccgccgaagaaaccgagcggaatggagacaacaagcgcacaaggacaagaaatcactaaaaagataagcgcgcggtacacccaatcggaaagcgcggcgccagaaagaacaagcggcggaacaaaggccagcaataccgcgatgatcacaacagcaggtgtataatacttggcaaacttcgtgataaagttttctgtccgggctttacggctgctcgcattctgaaccaagtctaatatttttgatactgctgattcttgatagccctttgtgacttcaatatgcagaacgccgttttgattgataaagcctgacattacatcttgtcctaccgcagcttttctcggaacggactcacctgttaaagcagatgtatcaaccatcgctgacccttgcacgaccttaccgtccaggggtatgctttctcccggattaaccacaatgatgtctcctgtctgaacgtcctccggggaaacctgttcgatgctgttctttgttttgagattggcgtaatcaggccgtatgtccattaacacactaattgattttctggaacggctgaccgcggcaccttgaaaaagctcaccgatttgataaaacagcataacggcgacgccctcagggtattgctgaatcagaaaggcgccgattgtggcaagagccattaagaaatgctcatcaaacacctgaccgcggatgatgtttttgactgcgcggatcataatgtcaccgccgatgatcaaataagcagcgaggaaaaggaaaagttcaatggttcccgaatgaaccaaatatgccgctgcgccgagaatgacagccgccgccattctgatcagcatattgaccattctattacgatagccatcatcagctgatttctttttatgcttttggcgaaccgttacatgcggatcaattgatttcacttttttctctactttattcgtgacccattgctcttctttcccatcggctgagacagttaaggtgcttgccgcaaaatttaccgcgcatccgtcaatgccttttatgcctttgactccattttcgattttttgggcacaattgctgcaatccaaaccgtccagaacgtattcctgtttcactagtctcaccttaccttccgatttagggttcccacttcaaagcgtatcaatgagtattgcattctttataatatatatgagcatatactcatataatagttacacctattatatgttgttttccaagaaagtgtcaatgaaaaacaaaaaccggcatatagccggtttttcattttactttttgcagacgaagagcattcagaacaacggaaacggagctgaatgccattgctgctcctgctatccacggtgctaaaaatccaagtgctgcgattgggatgccgaggctgttatagccaagcgcccagaataagttttgtttaatgtttttcattgtcaatctgctcatgcggattgcgtcggcaatgctgttcagatcgccgcgaataagtgtaatgtctgctgtttccatggcaatgtccgttccagttccaatcgccatgccgatgtcagctgtggcaagcgccggcgcatcgttaattccgtcgcctaccattgccgtctggcggccttctttttgtaggcgggcgatttctgctgccttttgttcaggaaggacttccgcaatgatattcgtaattcccgcttccttcgcaatggcttctgcagttctgcgattgtctcctgtcatcatgatgacatcaaggcccaattctttcagacgggcaacagccttccgcgacgtgtccttaatcgtatctgcaaccgctactagcccagctgcttctccatcaatggatacaagcataactgtttttccttctgcctctagctcttccattttggcgagaagagccccatgctcaacctgtttgctctccattaattttcttgtgccgacgaggatgctttttcctccagcttcagccaaaatgcctgcgccgacttttgcttcaaagcgggtaagcttcggtatctcaagccctttatctttcacgccagcaataatcgcttcgccaagcggatgctctgatcccgtttccgctgccgctgcaaattgaagcaaatctttttcttcaaaatggccgaatggaatggcatctgtcagacgcggcttcccgtttgtcacggttccggttttatcaagaacaattgtatcgagacgatgtgttttttctaaatgctcgccgcctttaaataaaatcccgaattcagcagcgcgtccagatccagccattatgctcgtcggagtggcaagaccgagggcgcaaggacaggcaatgacaagaaccgcaatgaacttgctgatcgcttcggcaaaatcgccaggagccgcccaaagataccaaatgagaaaagtgagaacggcaatccccaatacaatgggaacaaaaatacctgaaatctggtcagcgagacgctggatcggcgcttttgacccttgtgcttcctcaacaattttgatgatatgagaaagcgcagtatcctttccgacgttgacagctttaattttcagaaagccgtttgcgttaacggttgaacctgtcacgctgtcaccaggatttttgtcaacaggaagactttctcctgtaatcatcgattcgtcaaccgctgagcggccttcaaccacttctccgtcgacaggaattcgttcgccaggtttgacgtaaacaatgtcattaacaagcacttcgtcgatcgggatgatttgctcctgtccgtctcttacaacagtagctgttttcgcttgaagcttcatcagctttttaatcgcatccgaggaacggccttttgcttttgtttcaaacaacttgcctaataaaatcagcgtcagcaaaatcgcgcttgtttcatagtaaaggccgtctgtatgcccgtgagagccaaggctttgaaaagtaagataaagactataagcgtaagcagccgtcgtaccgagggcgaccaatacatccatattggcgcttttatttctgagcgccttatatgcacccacataaaacggccagccgatcagaaattggactggtgtcgccagcgcaaattgcatccacggattgagaaatatatccggtacccaaatgaatgatgtaaatgtaaaatggctcaccatcgcccaaagcaatggaaatgacaggacagctgaaaaaatcagtctcgccgtttgcttcctttcttctttctttttagcagcagcagcctcactgtcctgttcacccttcaactttagcttatatccaagcttatttaccgcttctttcaaatcgctgacagacgcttctttcggattgtattcgaccgtaactgtttctaaagcgaagtttactggagcatttgcgacgccttctattttgttaagccgtttttcaatccgattggagcaagccgcacaggtcatgccttcaatatcgaattcagctttttctgtaacgacgtgatagcccagcttttctattttttcttgaatcgctgcagtccctgtttcagcaggatcgtagattacatttgatgtttccgtcgccagattaacatttgcatccgtgacaccgggcatccgcttcagtcctttttcaattctggcagcacatgccgcacaggtcataccagagacctgcatcgcgatttccttttgttcactcaacatactcactcctttatatacacctggggggtatataaaaatgaaagaaatatcgcgcctccctataggcgcgataccttgaatcactcagctacgtcatagccctgatcttctatcgcatccgcaatatctttgactgatactttgtcagcatcaaacgaaacatcgactttacccgcttccagattgacatgaacggcactgacgccgtccagttctcctacgcttgtttctactgctttgacgcagtgctgacaagacattccttcaacttgcaatgttttttgttccataatcaattcctcctgtttattctttctattttcatcctaccatacccctgtagggtattacaataaaaaaacgctttatgattttgtgaactttttaaatacgtccaaaagctcagaaatggcctgttccccgtctccgcttttgatggcatctgctacacaatgatgggcatgatcctcaagcaaatgaagcgccacatttttcattgccgcctgaacagctgaaatttgcacaagaatatctacacaatatctgtcgttttccaccatgttttgaatgcctctgacctggccctcaatccgcttaagccggtttgtaatctgatccttttctttcgagcttttatggtttaatgttttatgttcgttatgcttttccatgcgtacacctctgtttaatgatattaattcccattatactgattgtccaaacggttgtctaagcatgccgatccaaaaaatgaatcagttaggttttaccatttgatcaggagggtatatacttctgttgataacgcttttaaaggggagaagaaaagtggacacgatcaaggttggaatattaggatacggattgtccggttctgtttttcacgggccgctgctggatgttctggatgaatatcaaatcagcaaaatcatgacatctcggacagaagaagtgaaacgggactttccagatgctgaggttgtacatgagcttgaggaaatcacaaatgaccctgccattgagcttgtcattgtcaccaccccgagcggccttcattacgagcatgctatggcatgcatacaggccggaaaacatgttgtgatggaaaaaccaatgacagcaacggccgaagagggggaaacattaaaaagggctgccgatgaaaaaggcgtattattaagcgtatatcataaccgacgctgggataacgactttttaacgattaaaaagctgatctctgagggatctcttgaagatatcaatacatatcaagtttcctatgaccgctacagacctgaagttcaagcgcggtggcgggaaaaagaaggcactgccactggtacgctgtatgatctcggctcccacatcatagaccaaaccctgcatttgtttgggatgcctaaagccgtgactgcaaacgtgatggcccagcgggaaaatgctgaaacggttgactattttcatttaaccctggactatggcaagcttcaagccattctatacggaggatcaatcgttccggcaaacggacctcgttatcaaatccatggaaaagattccagctttatcaaatatggaattgacggacaggaagacgcactcagagcgggaagaaaaccagaggatgacagctggggtgcggatgatccggagttttacggacagcttacaaccattcgtggctccgacaaaaaaacagaaacgatcccatcagtaaatggctcctaccttacttattaccgcaaaatagcggaaagcatacgggaaggtgctgcgctgccagtcactgctgaggaaggtattaatgtcatccgcatcattgaagccgcgatgaaaagcagtaaagagaaacgaaccattatgctggagcaataaaacaaaagcctccccaagtaaggggaggctttttcattagaatgtttttcctgcttctttcgcacgcgcaatcgcgtcttctttgatttgctgtgctttatcaggctccgcattatgtccctctacgaaaatgccatcgaaggatggtacgccgaaaaaattcatcatgatgccgatgtagcggtgtcccatttccatctcagccgcagggccttctgaatagtagccgccgcgcgcttggatatgaattgcttttttatcagttaacaagccgacaggaccttgttctgtgtatttgaatgattttcctgcaacagcaacagaatcgagatacgctttcatcactggcgggaatgagaagttccataaaggagtaacaaatacgtacttatcagctgatgcaaattgatcgctaagctctcccaaacggcctactttcgctttttcgctttcagaaagctcttcaaagcctgtacctgactgaagctttccccatccgctaaatacatctgcgtcaatgtgcgggatgttttctttgtacaaatcgatatgtacaacttcatcatttggattcgcttctttgtaagattcgataaatgctttacctgttgccatactgtacgaagttgcttcgtcatgcggatgagcagtgatatataatacttttgccatttttaccagccctttcgtttttaaaaatcacacatcaattattatcatacagatgcataatgattattctgtctctcttagactttattataaagacaaagaaatttactttcaagtaaaatatctcgaattaaagattatttaactttcccaaacagcttacttttcaaaagctgttctcaagccggaatacagcgcggacagttctttactgattcgaggataatgagggacatgcggcacttgaatatccgcaggcatccttttcactataaaggattgctcagccttttcaaaaaacgcccccagctggttgatctcttcatcagaaaacggagcaggcggacggcggtgagcttgggccgaaagcaaatagtaccctaagtgctgagcaccggaaatggcaggccagagcgcatccgcattcgcgtgaggaaactcgccaagcgccttgtcatacgcatcccgaagcctgacaagactcacccttaacttgtgttcgtcggcaatttgcccggttaacagtttctccataaactgcccttccagccggatgacattccgcacaagttctggcagccgcttggttgaaaaccgccgccacaaaagcattgttcccaacagcccgatcacgctgccgacagctacatcagtcagcctcgctatcataaaataaccggcacccgcgccgccatgcatactttctgtgataacaagcgcatttgcggttaaaaagggaacagccagcgcataattgcggacgatcagcatctcaagaagacattgcagcgctgcaatacaaaacgcaatataaacaccgcccagcttaaaaaacaggattgcacctgccagcataacaccgatcaccgttccggccgaacgctgaatagccctgtgaagcgtaaaaacaacagtagtgccaagcatgaccgctgctgccgaaagcggaatccaataggagcgtgcaaagccgaatgcgagggcaaacatatcggcggcaaacagaacaattccgtactttaacgctctaatcaaaactggagacttccagtcaaaagcatttctcaaaaagtaaaaagaggatggcaggcggcttggttccccgtcaagctgcttatcaaaacgtcctgaagcgatatgcaaaacctcattgatttcttcaaacagcttccgcctaggctcagattcgttctcattaatctgaaacgtaccgaaaacccgtgcatgcgcaagcatatctccggtttggcgaagtgccttttcaatctgcgcggtctctctgtccggcgtttcagctgaaaaatgaataatggcaatgaatatgtcgtcagctttttcaagcaggcggaaaaaccgttcatcatgccgcgattttttccgtttattccctttcccaagaaccgtttgtcgggctgttctaagcatgagcaccgtctgatgctgtgcgttatgaaaacctggcgttccgacggctgaaagacatgcagccagctgatgatatgttttttgcagcaccgctccctccggtccatgtttgttccataaccagccgattaaagcgatacccatggcgaaaatgccgccgagaaacgtcagtcccgctctgaacagcgcttgtgaaggatcggccggcagcccggaactgactaaaaaggcaaggacaaaaaacatcggcgcagggccttgaatgccgagcgcgctaaaaataaacatcgccgctgcaccgatcagccccaaaacagccgccatcatccaaagcatcccggacaaaagtgtccctaaaccaaatgagagggcgatcccaatagaaaccaagagcagcttcaaggcgcgctttttgtacgattcaccgcccgcatataaataaacaaagcctccgatacttgcaattaatccgtaatccgtgtgacctgccaatgcaccgaccagcacaggaaaccctgaagcgaaacctgatccgatagcctttttccaaggaaatggatttgcatgaatgcgaaaggcatccttcacgataggcatgattctttgattgttcgcagcagttttgttcatttgacaaaatccttttcaatgaatgtgtagaacttttcccgtttcttcgctttagtatgcccaaaaacgcggttagcttctcaattggtgcgcccgataaaaaaacagagacttataccgtctctgcttcattacatcagtttattataaaagcggcacctgtcaggactgttttgtccttctgccttccttcaagagcaggtgaataaaaaataaaggataaatcaatagatacccattaaacagccaccacacaagatcaaagtcactgctgaatgtccagaatgatagcgcctgcagacctgaacaacaggtcagcacaagagaaatcagcgccatcagcttccagtcagctcgattcacccgctgtaggtacaagctgtacaaccctgtgacagaaatcaggatatccagcggaaaaaaagaccagttccaagcgatcataaacggatggtcatgatgtttaaaagcccagctttccggtatgagagaaaacccggctgacagccagtacaagataaaaccgatatcagtcacgagaaaaaacagcttcatatatctcatttgtactgcccgcttttatgtaccggctcagacaccgcagcatgctcgatcaggtttaaagacacaacaccggcaataatcaaaccaattgaaatgactttcatgacactaacatgttcttgaaaaaacaaaaaaccaatgactgtaatcaggacgattcccatccctgaccatacagcataagcaacagatacatctattgattttagcgtaagcgtcagaaagaaaagactccctccataaaagaaaatcaacagcaaactgggaataagctttgtaaaaccagacgatagcttcatgctgaccgttcccgcaacttcaaacaaaatcgccaagcatagaaacacccaattcatgtcgcatcagcctcctcatcagctgttataccgttaaacaaaacatctacaattgattcaagcacctctcctgtcatgaactgatgtttcagcggatattcagggtcatacacttgattgatgctccctatatacatgtgaacaaacaggtccggattgatgtttctaattctcttttgctgtttgcactcgtctaataattctaggacaatggcccattctgccttaataaacgtgtctaatgtaagccacgcatcgtaatggtatttctttagttcatttaataatcccatgttcagcagttccatcccctgcggaaggctgatcagcatttttttcaccttttcaagcacatttaaactttcattttcatagatgtctctttctatttgcttcatttcagctataaattgttcgacaaccgcctcaacaagctgatctttagatgaataatatgcatagagagtccgcttgctcgttcccagcgctgccgccaaatcattcatcgtaaatgaaaatcctttctgcttgatcagccggaaggtttccgccagaattcttttatccatattaatcccccgctttcggtaccaagaaaactatttcggtaccaatattatacggcagaaatttatggaaagcaacaatatataaaaaaacctctcctattgggagaggtttaaaagacactgcggaccaaaccgccgtccgcccgaagtgccgcgccattgatcgcagaggaaagcggactgcttaaaaatgtaacaaagtgggcgatttcttccggacggatcagtctttgaataatagatgtcggccggttttctttcataaaacgtgcctcagcttcttgaacagtcaggttttcaccaggatacagcgagttcagcatggtttccacaccctctgttaaggtagagcccggcatgacggtgttgactgtgacattcgtgccggttgccagctccgccaaactgcgggaaatggacagctgcatcgtttttgtcgcactgtaatgcgccatttcctgtgacggcataatcgccgcttcactggcaatgaaaatcacacgcccttcctttttctctatcatgttatgcaaatacctgcgtgtcagccttacaccgctcataatattcacttcaaaaaaacgaaaccattcatcgtcgggaatatcaaaatactccgccggttcaaaaatccctaaattgttgaccaaaatatcaacctctggatatgcctgaaacagctcattgcagccttcttctgttcccaaatcaaatgcagccggataaagaaccgcttcagcatgttgtgttttcagttcatctatcgtctgattcactttctcttcccggcgtccgttaatgatcactgccgcaccttcttcagctaacgaagaggcaatagcttttccgatcccagatgtcgaaccggtcaccagtgcggtttttccttgtaaattcagcttcattattcatccctccgtttttgattcctcttatttattgacagaaatctgattggtgaaacatctgctctgcaatcagtatgaaacagctgggattgaaatggaagtacgcactttttggtgcctgtggtttggagaaaaaataaagcagaaccctctaagaggttctgctttattgtcagtatgtatggagacggtgggagtcgaacccacgtccagaaacatcgattacttaagcgtctacgagcgtagcctgcatatttatggtttcactcatcttcttgcctgcgggcgggccttccgagagctagtctgttcatctcttcttacgttctcagacaggaacgcaagcgtagcctacttggatgtgctcttcacagacacataggcaatgtcaggaagagctcgctgcgcttattaggcagctaatgctacgttttggttaaaactgttagttttgccagttatatttaagtgcgtttttacgagatcgcctctcggctcgcagctcaagctcgatccatccctgtcgaatccgtaacgtccccttggtataagggaaatacgggagaaaatatcaagctctcactcaaactggctatagtcttattataacatgatcacggctcttttcaattgtcaaatccttcaaatgaatggcgtcgtgatctgatcgtgaacacagtatagcacaggcctgattttcgaatcaagcactatgcctttagaagcctttttgactgtctctgaacgctctttcgatttcccgcttcgcgtccttgcgcttcaggtcttcccgtttgtcatagttcttcttcccttttccaaggccgagaagcactttcgcaaagccgttttttaaatacagcttcagcggaacgagagaatagcctttttcctttgttaacccgatcagcttattaatctccttgcggtgcattaacagctttcttgtccggagcggatcgtggttatagcggtttccctgctcatatgggctgacgtgcatattgtggagaaacacttctccccgttcgattttggcgaaggaatctttaaggtttacgcggccggcgcgaatcgatttgatttcggttccttgcagaacgatgcctgtttcataggtttcttctataaaataatcgtggttggctttcttattttgagataatacttttcctgacccttttggcatgccagaacctcctctctctaaggaaaaactgtccaccttttgcgatacgctctattttaccaaatgtcacgtaccgctacaatgaaaagctgtttccgaaagaaagcaaatagagcgctgcggccctatttgctggttgagctgctatttcttctttttccgtttctgtttcggagcattctggaagccgcgttttttctttttcttcttcggcttagtgaaccactcccctttttcctcagacggagctggagaaacaggtgtattggtgctttgaacacgttttctggcaggctttccgcgttttctgctccggctgctgtccaattctctcggacgccgcggagtgcccttcatgccgacaatttcaaagtcgatattgcgctcatctttattgacatcgacaaccttgactgtgatttcatccccgatgcggaagacgttgcctgtccgctcgccaatcattgcgaaatgctgttcgtcaaagcggtagtagtcatctgtcataaagctgacatggacgagtccttcaattgtattcggcagctcgacgaacattccgaagtttgtcacagagctgatcatgccgtcaaactcttcaccgattttatcaagcatgtattccgcttttttcaggtcatccgtctcacgctcggcgtcaactgcacggcgctccatagatgatgtatgttcggcgatatccggcaggcgttcagcccacttttcctgtgtcgcttcatcgactttgccgttgatcaaatacgttcggatcagacggtgaacgattaagtccgggtaacggcggatcggcgatgtgaaatgcgtatagaattccgttgacagaccgaagtgccccaagctttgcgggtcgtatttcgcctgtttcatcgaacggagcataacagtagatataaccgtttcctctggtctgtcacgtacagcgtccagaatgctttgcagcgcgcgcggatgaatattccccgccgttcctttcaccacatagccaaatgtcgtcacaaattctaaaaacttttgcagcttttcagcattcggctcttcgtgaatccggtatataaacgggacgttcatccaatggaaatgctccgccactgtttcgtttgccacaagcataaattcttcaatcagcttctcggcgacagagcgttctctgatcacaacgtctttaaccgctccttcgtcatcaacaagcacctttgcttctttgaaatcaaagtcaacggcgccgcggtccatccgcttatcgcgaagaatttgagccaggcgctccatgtctttgaacatcggaacaagaggctcgtatttttgcttcagctcttcatcatcatcaacaagaattttattcacatctgaatatgtcattctttccgttgttttgatgacactttggaagatctcgtgctctgtcacctgtccctgactgttaattgtcatttcacaagaaagcgtcaggcggtcaacctttggatttaaggagcagatgccgtttgacaatctgtgcggaatcatcgggatgacacggtcaaccagatacacacttgtccctctttcaagcgcttctttgtcaatcggcgagttttcggttacgtaatggctgacatcagctatgtgaacgccaagcttgtagcttccatcatcaagtttcgtcacggtaactgcatcatccaaatccttcgcatccgcaccatcaatggtgacaatcacctggtcacggagatcacggcggtctttcagatctttttcatcaatcgtgtcaggcgtacttgatgcctgttccatcgcgtcagctggaaattctcccggcaggccgtgcttatgaatgaccgataaaatatcaatgcctgggtcgtttttgtggccgagaatggtttcaacctcaccctctgcgttcatgcggccttcaggatagctcgtcagcttgacaacaaccttatgcccttccgcagctccatttttcccatttttcggaatgaagatgtcactcgtgatttttttgtcgtccggaatgacaaagccgaagtttctcgtttctgtatacgtgccgacaacccgctgaatcgctctttctaaaatccgtatgacggttccttcctgcctggagccgcttgactgtgaatttagacgcaccatgacgatatcgccgttcattgccgtatttagctcattaggcggaataaacacatcacttaacgacgtatcctcaggcagcaaaaaggcgaatcctttcgcatgggctgaaatctttccttttattaagttcatcttctccggaatgccgtagcggtcgcttctcgtccgtacgataagccctttttcttccaaggcgactaacgctttgacgagctctttaaactcctcggcttccgtaatatttaacatctcctcaagttcctgaacggtcagaggtttgtacgcctcttccttcataaacgagagaagcttttccataaatgcttctttttccattatccgacctcctgttgattaccaatcgagcttctctaaaaattcatacacatcctgatggacgaggtcacgttctttgtcgagtgtaatgacatgccctgattcctcgtaccatttcagctgtttatcatcagtttccacttcgttgtaaataatattggcgctttcggtattaatcatgtggtcatgacgggcctgcaccacaaatgtcggtgaataaatcatatcgacattattccgcacatcagcaattaagtcttgtagcgccttgagggtattcatcggcgttttttcgaattctttcatttcctcttcaatttgctccgggcttttcccctcaaactttttgtaattgcgagcgtatgaaagaacgccttgatacatgacctcttcactcttaatatgcatcggtgcgcacattgggacaattccctttatgggtacagtgtaacccaatttcagcgaaaaaaccccgccaagcgacagtccgcaggcagcaatgctctcatagccttcagattttaagtattcatagccatccattacgtttttccaccagtcttcgggccccgtatgtacaagttcttcaggcgggacgccatgtccttcatattgaggcgcgtggcacgtatagccgcgttcattcaaatatcgtcccagcatccttacatccgctgtattgcctgtaaagccgtgcagcaaaagcaccgctttgtctccgcctttaaatgtaaatggttttggtgtcacaactttcatgctcatgtctccctttctatctgcacgatcattttagttttccacagtttaatcagaaaaaaacgttttgaatatcatccagaaacgtgaaaaaggcctgacttcacatcagaccttatacaaacattgccctataggatataagcaagcgcaatcgttaacacgaaaaacaagactgccagcactaccgtaatgcggtgcaaaattaaatcaagacctcttgctttttgtttcccgaagagctgctccgctccgcctgaaatcgcaccagataatccggcgcttttactggattgaagcaaaacgacaataataagtgcaatgctgacgataaccaataaggtaatcaaaactgcgtgcatcccatacacctccagactcactggctacattacttctattttacatgaaaagggttggcatgtcacgctgtatcagacgccaaaaggccggataagacgttttatcttggttaccctattcatatgaaaaggacaaaggagaaaagcgatgccgcttatcagcatagacagcaggaaacatcttttttatgaagaatatggacagggaatccctatcatttttatccacccgccgggcatgggacgcaaggttttttattatcagcgccttctatccaagcatttcagggtgatttttcccgatttaagcggccacggtgatagtgatcatatcgatcagccagcgtctatttcctattacgcaaacgagatcgcgcaattcatggacgctttggatattgataaagctgtgttattcgggtattctgccggaggcttaatcgcgcagcataccggcttcacccgccccgacaaagtgtcacaccttattctgtccggcgcctaccccgctgttcataacgtaatcggccagaagctgcacaaactgggaatgtatctgcttgaaaaaaaccccggtttgctcatgaaaatcctcgctggcagccacacaaaagacagacagcttcgcagcatattaacagaccatatgaaaaaagcagacctggcccattggcatcagtattatctggattcgcttggctacagctgcattgaacagctgccccgcctagaaatgccaatgctgtttatgtatggcggcctgcgggactggacctttacaaacgcaggctattaccgaagatcgtgcagacatgccgaatttttcagattggaatatcagggacatcaattgccgacaaaacaatggaaaacgtgcaatgagctggtgacacggtttgtgctgacacatcattcaatatagaaaacgttggatctccttgcgttttctatattttattgacttttgtcaacaaaatcatagtaaaaaagatcctcaaatttcaaattaaaatagtgaagcattttaccgatcacaagctgccccggccgtctttctccattcagcacgcggctcagtgtggcgggtgagactccgatttccagcgcaagctgattaagggaataatcgttattaaccatatactgcaagacataatcacgtctaatctgtatcttttctactggcactttcctcaccttccattcctgaaaaacttttttctatacttttacattacggcttatgttaacttttgtcaatacatttccagtctacctattccctttagtcaataaacatactaaaatatgagtaacagtgagggacggggtgagatatatggaaagctttggcgaacaattacgggcattgcgtgaagagagaaagttaacagtcaaccagctggcgacttattcaggcgtaagcgcggccggcatctccagaatcgaaaacggaaaacggggcgttcccaaacctgccaccatcaaaaaactggcagaggccttaaaaattccttatgaggggcttatgtacaaggctggttacatcgaagaagtgcatgaagccagggccccttacgaaacgaagtgcaagctgcttgaaaaagcggaggcctatgacctgaaaaaccttgcgcttcttgagaacgaaaagtggcaatatctcaataaagaagatttgctcatgctggatcattatttttcgtttatttcagacgaagccaaaaaacggtctgctgatgactgactcttgatagaaatgtgaggcgatagaccatgtcaccgttcggacagcaattacgggagctgcgccgcgcccgcaaactgacagtgaatcagcttgcggtgtactcaggcatcagctcggccaccatttcaaaaattgaaaacggcaaacgcgggacgccaaaacccgccacgattaaaaaactggcagccgtcctgaaagtgccgtacgaaaacctaatggccgccgcaggccatattcaggcctttcctgaagaaatccgcgaagcatctgaaagctatcaatccgtttatgaaatttaccagacggctgtcactcgcggagcggagcacctcccgattttcaatagtcaaaaatgggaacatctctcaaagcaggatattgaaaatctcagcaaatacttcgattttttgtcttcagaagcaaaaaaacgcgcctcttcctcataatcccctgtttctctttctatattttatcaatcacgcttgcataccctccctcgttatttgcgttataatagtgacagacgaggtgaaaagtatgaaccaatcagaaatgtgtcctagatttgaaaaagcagtcgacatcttaagtaaacgctgggtcgctttaatcgtatttcagctcttgaacgggtctcagcgatttagcgaaattgaagcagcacttccaaatctaagcggcagagttctgtcagaacggctgaaagaacttgagcttgaaggagtagtgaagcgggatgtcatccctgaaactccggttcgcatcgaatattcattgactgataaaggaaaggcactagcacccattttaggtgagatttctaaatgggcgactgaatggattgacccttcctttcttgactaattgctaaaacggctctgatctcaaagatgagaaaagagccgttttttattttttcccaggtgaaaaaacgatttctcagccgatatatagtacatccacacattacgtttttaaaggagaccactatatgcgactgacgatttcccgcaaattcagcctggtatttttgacactgatcctgatcaatttacttgtaggcggaataggcgttcttaatatgcagcatatcattcaaaaaacagatgaaatcaacacaaaatggattgacggcatcaaaggaatcacttcaattaattatgtaaccgagcacctgtcttctaaagaaaaggactttctgatttatacagacaaaagcaaaatggatacacttgatcaagaaatgaatcaaatcatggaagacattaaccaaaagctcgataactacgaaaaaacgatctccactgataaagagcagaaactgttcgagcagcttcaaactgaagtgaatacctatatggatattcatgcgcaaattatcgaaagcggccgcacgaatgacatggacaaagcaagaggtttattggttcagactgaggccagctttgaggatatgaaaaaaacaatcactcagcttgttgacttaaatcaagaaggcagcaacacagcggtaaaagaaacgaaggccgtctatcataaagggctcatttacactgctttgcttgtggcagcttcgatcctcatcagcattttcatctggctttatatcacgcgaaacattgtaaagcctatcattcgcatgaaggaatctgccaatcatattgccgaaggcgatctgtcgaacgatatggagccgctcaactcaaaagacgagctgggtgatctgaatgaagcgctgcaaaaaatggtagggaatctgagagatattgtcggatattctaaagacatatcaagccgggttctttcttcttcacaggtgcttgcaaccgcaacgaatgaaacaagatccggcagcaaacatattaccgagacgatgaacgaaatggctgagggctctgaacagcaggcccaagacgccgtgacgattgccgaatcgatgaatgagttcactgaaagcattgataaagcctataatcacggcatcaccatcagcgatacgtctcaaaacgttctcgaactcgcggtaagcggaaacgaaaatatggctacgtcattacagcaaatgaaaaccatccatcatattgttgaagaagccgtgcataaagtgagatcactggaacagcattctcaggatatcaacaagctcgttcaagtcatcaacggaattgccgagcaaacgaatttgctgtcccttaacgccgcaattgaagctgcccgcgcaggagaaagcggcaaaggcttcgccgttgtggctgatgaagtcagaaagctggctgacggcgtttctgattccgtgcaggacattacccggattgtaaacgggacacagcaggagatccacactgtcattacgtacttggaaagcagctttacagaagtcgaaaaaggaacggaaaacctgacagacaccggacaggctatgcagcatatcaaacaatccgtcacccatgttgcagacagcattaaggaagtaacggatggcctgaagcagttaacaaaccaatcgattaccatcaatcaatcgattgaaaatatcgcttctgtatccgaagagtctgccgccggcattgaagaaacattttcaattaccgagcaatccgcccattcgatggatcaagtgcttctaaatgctgaagagcttgagcagctggccaatgagcttaatgagaagatgggtcagtttacgatttaaatagaaaaaagaggctggactccagcctctttttctattctatgcagctgattgaacatgtttcgccccggttctttttttcttcaccggacttaatgcccgctccagccaagccatgagcaaatccgcccctaccgccatcaccgcagttggtatcgctccggctagaataatcgcagttccgtttgttgcgtttgagccgcggacaatcatgtccccaaggcctccggcaccgacaaatgtgccgatcgctgtaattccgatggcaatgacgagagccgtgcgaaggcccgccataatgacagaaagtgcgagcgggagctcaaccattctgagtacttggaatttcgtcatgcccattgcttttcccgattctaagtaggcatgttcaatactgataatgcctgtgtacgtgtttcgaataatcggcagcagggaatacagaaataatgatagaatcacggtatttgcgccgagccccataacaagcattaagacggccagcatagcgagcgccgggattgtttgaataacgtttgttacggcaaacacccaggctgacaaacggcgaaaatgcgcgatgaggattccggccggaaccccgacgacagcggcaaataaaacgccgtaagccgacatgagaaagtggcggccgaattcatccatgacgtaactgccattctgcgcgtaatacgtcattaactgttcaagcacgttcattgacctcttccccctttcacgattcgaagtagtgatgtttttctaaatattccttggcaacgacagacggttctttgagattgccgtcgacttcatagttaagctcctgcatcgtggttgtgtcgatttttccgagcattttcttgatgatgccttcaagctcaggatgttctttgagcaccttttccggaacaaccggagagcagtcgtacggcgggaaaaattgtttatcatcctttagcattttgagaccataggacttgattcttccatcggttgaatacgcaagcacaatgtccatttttccgcttttcaccgcgtcgtacacaaggccgatctgcatcggatacgtgccgccgaatgtcatgccgtaggttttcgtaaaatcctgatagccgtttcctttgagcttcatccaatagttatcaacgcccagctttaattgcggcgcccattttttaacgtctgatacggtctctaaatggtattggtcggccagttccttgctgactgtaaaggcatatgtattatcaaacccgtaggagttataccattttaaattgtatctttttttaaactcccgctgagtaagcgccagcgctttgtccggatctttttcaggttccattctcaacgtgcctgtcagcgcgtctcccgtatatcttgtggccgcaatgtcaatttccccgttcattaaagcctgctgctgcaccgcgttggagccaagatttttaatcgttgttgttttgagatcagtatggtgttcgatcaactggccaagcatactagcgatgatttctgattcgctcatgctttgcgcgccgattttaatggtctggtctgcagcagcgctgagaccaggaagcgaacagccgctcagcgtcagcgttgccgcaagtgctaaacctatgattaatttgaggtattttcttttcatgagccccctccttatgacaattcattcaatctctgcatgccggcaggtgtcagttttcgttcagcaactgcaagcacataatcaatcacaattgccaatatcgtgacaggtaccgcgcccccgatgatatattccggctgatataaattcagtccgataaaaatgtaatcacccaatccgccgcctccgataaaggaagcaagcgtggcccagccgattaagtaaatcgtcgatgtcctgattcccgccatgatcactggcgcggcaagcggcagctccaccaagcggacttgttcagccggcgtcattccgattcctttaccagactcgagcagatttttgttgacgccgcgaatgccggtatacgtgttgcgaagaatcggcaatacggaatagaaaaacaaagccacaatggccggaaccttccctacaccaaggagcgggataaaaaaagcgaggatggccagactcggcagcgtctgaataatattgacaatgccgataatggtgccggctccttttttcattctggtaagcacaaccccgagggggacggcaaccagcacgcctaagatcacagcaatgagcgatatcgtaatatgctcgtatgttttataaagaagctcgcccccattggtttgcaaaaattgaacaatatgatgcatgacttatcgcccctccctatgacaatgctgcgagctgcttttcttctccccagagggagtcatacacgatgtcgaccagacttgccctcgtcacaattccgatcaggcgtcggtcttcatccacaacgggaacatatttgacaccccgttttaaaattttgcggaccgtgtcgcgcagcagtgtgccgcccagtactgtgtatatatcttcatgtaaaacttcactgacgagattggcctttttccggcattgatcaatgatttcaacatcgacatagccttgcagaccgcgctcgtcatcgacgaccagcaatgaatcgacccgttcctgcctcatcagctgaatggcctcagaaagcgttttatccgcggtgatcgttacaggctgtgtgttcataatctggtcaacccgttcaacatccgggctggatgactgaatcagccgctccttgccgataaattcctcaacaaattcgtctgccggatttcttaaaatgtcatcgggcgttccaacttgaacgatttctcccgcttttaaaatcacaatccggtctgccagcttaatcgcttcatccatatcgtgggtaacaaatacgatggttttatgtaaggttttttgcagttttttaaattcttcctggagggaatccctcgtaatcgggtcgagtgccccaaacggttcatccattaagataagcggcggctccgcggcaagtgcccgtaatacaccaattcgctgctgctgccccccgcttaattcatgagggtaacggtctacatattcaggccccatatcgaccaattttaaaagctcacgcgcccgctctttccgctgctgctccggccatttcagcagttttgggacgagtgagatattctgctgaatggtcatatggggaaacaggccgatctgctgaatcacatagccaattttgcgcctgagctctacaggatcctggtccatgatgttttcgccgtcaatgaaaatcttcccggcggaaggctcaattaatcggttaatcattttcattgttgttgtttttccgcagccgctcggcccgataaagcagataaattcgccttttgcaatcttaagatttacgttgttcacggcttttttgccgcccttgtatgttttcgagacattttctaatgtcagcaaacatcgcacctccaaaattaagtttattcaatttgttcagtttaaatttaatttttcagacaattgaatgcttcccattatagaataaagtttataaaataaaaagtttacaatttgttcatattatttataaagtatgtgtaaacgctgatttacccgcattgacgtgtgttgatctccttattgctccaatttcctgccaaattctcttttgacagcattttcgccgtatcaaaaatgtggtatattgacatcggaattgttagctgaaaggatgaaaccgttggagaaagatccgttaacgatcattgaacaagccgaggaccattttatagaaaaaatcgcggaaaacatgcatgcatttggaatgccctctaccgtcggacgagtgctgggcattatttatatgaatcgaaaaccgatgacgcttacggaattatctgaggccaccggcatgagcaaaacacgcatgagccaggtagtgcgggaaatgcttgatgccaacattgccgagaaggtgttcgaaaaaggcgtgcgaaaagatttatatgaggttgagcaggactactatcaaacatttatcacgctgttttcagccacctggagcaaagtcgtcagcaaaaacaaaatgatgcataaaaaactcaatcgggagctgcttagcgtgttggatgaagagcttactcctgaagcggaagaaaaagtgaatgagctgctgaaggaattaaaggaatggctcgattattataattggctcagccgtttgattgagttttttgagagcgaagaaatttttaaatatgtgccgaagccgtaaaaaacgccctgtcattacaaggcgttttttcttatgcggcacctgccaggtttttcttttttctctttttaatcgggcttaatgctcgttcaagccagcccatgaccaaatcggcaatcaccgccatcagagctgtggggatcgctcccgctaatataatcgcggttccgtttgtggcgtttgatcccctgacgatgatgtccccgagaccgcctgcaccgacaaatgtcccgatggccgtaatgccgatggcaatgacaagcgcggtgcgcaggccggccattatgaccgaaagcgcaagcggaagctcgaccatccgcagcacttgaaattttgtcatccccattgcttttccggattcaagataggcgtgctcaatactgataatccctgtatacgtatttctgataatcggcagaagagaatacagaaataatgacaatatcactgtattagcgcccagccccatgacaagcatcagcacggcaagcatggcgagagccgggatcgtctgaatgacgttcgtgaccgcaaaaacccatccgcttaatcttctgtatctggctatcaggatgccgagcggaattccaacaatggcggcaaataaaacgccgtataccgacatcagaaaatggcggtaaaactcctgcagcacataaccgccgttttgcgaatagtatgtgccaagctgctgtagtacttccatatgatccacctcttttcttagtcaaaataatgatgtttctctaaaaattcctttgctacgacagacggctccttcagcttgccatccacttcataattaagttcctgcatcgtttccgtgtcgatttgcccaatcagcttattgatcacaccttcaagctccggatgcgccttaagcaccttttccggaatcaccggtgaacagtcatacggcgggaagaaacgcttatcatcttttaagattttcaagtcataggctttaatccgtccatccgttgaataagccagaacggcgtccattttcccgtttttgactgcgtcatagacaagcccgatctgcattggataagttgtgccgaattcaaagccatatgtgctgacaaagcctttatacccgtcaccttttcgtttcagccaagcattgtcgacgcctaatttatattgggaggcattttttttcaggtcggacacggtgttaatatgctcattttccgcaaacttttttgttacggtgaaggcatacgtgttatcaaagccgtaggaatcaaaccatttataagaaaagcgcttttgaaactcgttctgcacaatgttcagcgctttttttggatctttctccgcttccttgccgagggtgcttgttaaatctgttccggaatagcgcgtggctgaaatatcaatgtcaccgcccagcatcgcttggtgctgaacatagtttgagccgaggtttttcactaaagcggtattcaaatctgtatcatgttcaataagctgcgcgatcatattcgctaaaatttctgattctgtcatgctttgcgccccgattttgatcgtgtcgtcagaagcgccgccgagacccggcagagagcagccgcctagcagcatgacaaagacgagagcaaacgcgccaagccatttgatttttgtcgttttcaacagagccaactccttacgaaacttccttcatcccttgtaatcctttcggcgtcacctttcgttctgtcacggctaggacataatcaatgataattgccagaattgtgacaggcacggcaccgccaatgatatattcaggctggtataggttcaggccgataaaaatatagtccccgaggccgcctcccccgataaacgacgcaagtgtcgcccagccaattaggtagatcgttgatgtgcggatccccgccatgatgatgggaattgccagcggaatttcaacgagccgaatctgctcccagcctgtcatgccaatccctttccccgattccaggaggtttttatttacacctttaatgccggtatacgtattgcgcaagatcggcagtaccgaatagaaaaataaagcgacaatcgcaggcacttttcctacgccgagaagcggaataaaaaaggctaaaatcgccagactcggcagggtttgcacaatgtttacgaaaccgataaccgcacctgcgccttttttcattctggtaagagcaacgccgagcggcactgcaacgataatgcccaatacaacggctatgagtgaaatatataaatgctctcctgttttatacagcagctctccgccgttcgtttgcaaaaaagtcatcatttgattcatcttaaaagagctcctcccctggtcagatcgtcatgagctggttttcctcgtcgccccaaatggaatcgtacacgatatcaacaaggctcgctcttgtcacaatccctgctaaatggttctgttcatcgacgaccggaacatacttgatcccctgcttcaaaatttttcggactgtatcgcgaagtagcgcccctttttgaacggtatatatatctgagcggtatacatcgccaacgatgctcgcttttttgcggttttgatcaatcatttccacatcaacatagcccttcagcacgttttgccggtccacaacgagcagcgagtcaacacgtttttctctcatcagctgaatcgcctgagaaagcgttttgtccgcagataccgtcaccggcgttctgttcatcatttgctctacccgctcgatatccggtcttgactgaatcaggcgctctttcccgataaattcttcaacaaactcatttgccgggtttcgaagaatctcatcaggtgtgccgacttgaacgatttctcccgcttttaatatcacaatcctgtcggcaagcttaatcgcttcatccatatcgtgggttacaaacacaatcgttttgtttaaggttctctgcagttttttgaattcttcctgaagggaatcacgcgtaatcggatcaagcgctccgaacggttcatccattaaaatgagagggggttccgctgccagggcgcgcagcacgccgattctctgctgctgtccgccgctgagctcatgcggataacggtctaaatactctgggcccatatccacaagctttaacagctcgcgcgcccgttctttccgtttttcctcaggccatttcagcagctttggtacgagtgagatgttctgctggatggtcatatgggggaacaaaccaatctgctgaatcacatagccgatttttctcctcagctcaaccgggtcctgttccataatattttctccgtcgataaagatccttccagacgatggttctatcagtctgttgatcatcttcatcgttgtcgtttttccgcagccgctcgggccgataaaacagataaattcaccttttgcaatatctaaatcaatgctgttcacagcttttttgccgcctttatatacttttgacacttgttccaatttcagcaatccgtgcacctccgcaggtttcctttaaattttctgaaaagtataatccttattatagtttgaactttgtaaaataaaaagtttacaatgtgttgaaattatatgttatttatagattatttattgttatgaccgagacggaaagggtgttcttacaattacgccggatacctcccacttcctctgcattcagctattttcaacaccaggaagaaatatgatatattgacaccatcaattgccatttgaagggatgatcagctgtgaaaaaaaccgctctcgacatcattgaacatgctgaagagcatctcattgagaagattgccgaaaatatgcatacgtttggaatgccttcaactgtcggacgtgtgctcggaattatttatatgaatcgaaaaccaatgaccttaagcgagctctctgaggcaacgggcatgagcaaaacacggatgagccaggttgtccgggaaatgatcgatgccaatatcgccgaaaaggtgtttgaaaaaggcgtacgaaaagacctttatgacgtcgagcaggattattatcaaaccttcatttctttatttgcggcgaattggacaaaggtcgtgagcaaaaacaaagtgctgtataaaaaattaaaccgggagctgagtgatcttttacaaagggacgggcttaccccggaagcggaagagaaagtcaatcagctgctgaatgaattaaaagaatggcttcattactatgattggctgagcaggttgattgaattttttgagagtgaggaagtctttcggtacgtgccaaaaacaaaagaaagcagctctctaaaataagggagctgctttttgcatcatgaggttaagatcggaaacatgcctttcagccccgcaccaatcatcccgaccgcaaccacggctaagattaatcccatcagtctggtaatcacattcatctcggtttttccgagtttgctgctgataaaagcagaatagtggaaaaagagaaaggtcagggcaataacggcggctatgccgatcgtgacagccgcataatgaccaatgccgctatgaccggcggaaaggctcatcactgttgcaatcgttccgggcccagcaatgatcggaatggataaaggtgtgactgatatatccgctttttccttgctttccttatgttcatcatggtgaagagattgcacgtgtgattctttcgcattcaatagattataggcaatgccgaaaatgaatatgccgcccgccactcggagcgcgtaaatgttgatatcaaacagtttaaagataagatgaccgaaaaccaaaaaagctgcgagaataaaaaaggataaaatagctgccttccgggcaatcgcttttctttccgctgcagtatagccttctgtcagcgtcagaaatatcggtacgtttccgatcggattcgatactgcgaataaaaaatgaagacgtgaacgataaatgagaacatcatatacctccttgttgatagtctctgcacaggaaatagaattattctccacccttttacccggaggcgatttcccggtaaacctttatagcctgtcagaaacgcgccatgctacaatgaagtgacaaattgaataggaaggacgtatacagatgttcaaaaaaattgcggcagatgccttgggcttatctgatatcggaaaaattatcgtacctcaggactatgacaaaacagacgcagacgactatgtcatgcatgaagataatgagaaaatttatttcttgattaaaacaaaagcagacgagtattgctttacgaacctggccctgatccatgtagacggcgaacgcgccacttcctcgaaacgaacgttgaaacgctatccttattcgcaatataaaatctctgacgtttttcttgaaactgccggaaaagtggatttggatgttgaaattaagttcaagctgggcggtgaacaattcgacattgatgtccacaaagaccagattgaaaagttaaaagacctttataaagcactgcttcgcatcgctgaaacaacctatgaaaatgacattttaatcaatcaagcggagcaaagcttagataaagcagtgacgattcttcaccatacccgccctgagcacgtcaatattgaaacgcaatacaaagagctgaccgaattcggattcacttggctgacatccgttcgctcgcagtatcatattaaggattttggggatgtatttgagaaatatattaataactagataaaagaagacacagctgctatcgtgctcgtgtctttttttgtatgaatattgattactttacaacttttttcttttataataaaactattagtctattttccctatattacagataaaggagttattttatgtattgtcctcaatgcggccatcaaacagatggcggaaatttttgtgagaaatgcggatcaccgctccccggtcaatcaggccaccagcatgcagctcaaactggagccgctgcaaagcaagcagcaaaacagttcggttcatttgtcttatccgtcctgaaacgcccttatcaggaatgtaaagcaacaggcggagaacagctgatcagcgcaatcattacgatcgttcttttcagtttgctgacccctttgatgttttatattcttttttcagacggtcccgaaagcgtaagctttacagcaatcttcttagagccaaccatttattttattttatttctatttggcctgcatgcatgcatctttttcgccctgaaaatcgcgggaaaccaagtatctttcaaggattcattctcaagattcggagcgtttctcataccgtttacggctattttgattcttgcccttttcttctttttattacatacagacatttgctttaccatattagccgttggtttaatcggtgcattcttcgccattcctcctgcgatgctgagcagttaccagcattcatataaagggaaggttgatgtcatttactcaacgattgtaatttatctgatcatctgcgttacatttcagcttattatcgaacactatgtcaaagaaattttccgttatatgctcttttaaaaacaatcccatcacctgctggtgatgggattgttttattgaatagacgttaagtaaattcttccgttcttcactacgccggtgtaggtccagttatatgttctgagctttggactgccgcctgattttgtgatatagaattcttcatacgtcttaatcgtgatagccgacccattttggctccagcttttcacttcatagttattaaagtcttctgttgtcccctctttatttaatttcgacacgagatgctgctggtcggaataaagggaactgcctttttcaaggctgtcttccatcagtgagaaattattttgattcacggcatctgcctgactttgcagataactgcccataaataatgtcacttgttcatctgtaacatcgccgcttgcagagctttcactgcctttgtttttcgagccagcccaggcggaagtgtatgtctctggtttatcatttttgattttctttatatttgtgcctgcagattcgaatgttgattctgcatcttcgaaaatccactttttctgttttttatcatatgaaagaagatattcataactcggactgtcgtcagtcatttcagattttgtatagtcgttatacgaagaagactggtgaagttcttttcctgttaccgatacctgccacgttccgtcgtttttctgagagagggcaaatgtgtccaggtcaaaatcagtttccaagtatctatcttttaagtatgaatccgcgcttttcatagaatcgacggtgtccttcgtctccgccttccaattggcacttgcctctgtcatctgggctgtattcccatcagatagagctttggagtattgttttgttgttttgacaattgtgttcataatctgttcctgtgtatcttgatcaggaattaacgttaactccatttctttatcatcgatcggaacgccggcagtttttgtttttccccacggaaattctgcctcgactgaagctgtcattgatccatctgtcagcagcggaccatatgttacggatttgaacggatctttatgaattgacttgccgttaatcagcaaatctcccttcccgctcttgatgtcatccgctaagctgaatgtcacatcgtctgcttccaatgagagatcaacacgaaagctgctatcgccaatcgcctgaatgtcttcctttttcacaaggtcaacgacatcgtttttcagtttggctgagactgtatattcgccgggaatgtacggaccaagggtttgtgcttgatctgctttctttacagatccggcttcctctttattgacatatagatcggtatttttataattgctgctcacttcaaaataaacaggtgctacctttaagtcataatggtcaaataccagcaggcttttcccgtctttttctgcatatacgatatccttctgggctgtttcatcccgcagcgatgcaaaaagttcatcttttttgtctggatgatccttcaaatatgtaagaaacggttttacattatttttagtgagtttaagattgtcatttaccggtgtaagcagagtcgcgatttggtcctgatccccatcatttacggcctgttcaaacttgtctactaacctatcctttgaagtaaaatacgctccggttttatatgcggcgaataatataacgcacgccgcggcaatgctgctccataaaatgatggttttcttagggatcggttttcgcggagcctgccttgtttctgcagtgctagctgtttcttgatttgcctgtttgctaccccctccgatcggggtgccgcattgtttacaaaacttggctccttcattattctgggagccgcaattcttacaaaaaaacatgactttcctcctattctactaatttgataacatttactgcttttcatattttataataaaacagaatgaaattgggaacgaatgaaaaaattaaatgtctatcagactaaaaaggtggtacgaatatgcaaaagctcaggattgaattaggagaagaaacaaatgacgaactatatgatctattgctgctcgccgatccatcgaaagacattgtagatgaatatcttgagaggggagaatgttacacagcttgggccggtgatgagcttgcaggggtttatgtattgctaaaaacaaggccgcaaacagttgaaattgtaaatattgcggtaaaagaatctcttcagaagaaaggctttggcaaacagcttgtacttgacgccatcgaaaaagcgaagaagctgggggcggacacgattgaaatcggaacggggaattcgagcattcatcagctttccctctatcaaaaatgcggattccgcattcaggcgatcgaccacgatttctttctcagacattatgatgaggacatttttgaaaacgggattcaatgccgcgatatggtaaggctttatttggatctctgaaagcataaaaaagccgccgagagaaaatcccggcggtctttttattacttgtttaagttgtagaaagagttgataccgtggtattgagcagtttcagccaactgatcttcgatgcgaagaagctggttgtatttcgcaacacggtccgtacgagacggagcacctgttttgatttgtcctgcgtttgttgccacagcgatgtcagcgattgtgctgtcttcagtttcaccagaacggtgagagataacagctgtgtagcctgcgcgtttcgccatttcgatcgcatcgaatgtttcagtcaatgtaccgatttggtttactttgatcaggatagagttgcctacgccgtttttaataccttcagaaagttttttcgtgtttgtaacgaagaggtcgtcaccaacaagctgaacttttttgccaagacgctcagtaagaagcttgtggccttcccagtcgttttcgtcaagtccgtcttcgatcgagatgattgggtatttagaaacaagctcttcataccagtcaaccatttcagcagatgttttcacaacgccttcgccagacagatggtatttgccgtcttctttgttgtagaactcagaagatgcagcatccatagcaagtttaacttcttcgccaggtttgaagccggctttttcgattgcttcaacgattgtttgaagcgcttcttcgttagaaccaaggtttggagcgaatccgccttcgtcacctacagcagtgtttaagccttttgcgcttaatactgatttcaggctgtggaagatttgagcgcccatgcgaagtgcttcacggaagttaggagcacctacaggcatgatcatgaattcttgaatatccacgttgttatcagcatgctctccgccgtttacgatgttcatcatcggtacaggaagcgtttttgagttgaatcctccaaggtattggtaaagaggaatctgtaagaaatcagcagcagcacgcgcacaagccatagatacgccaaggattgcgttcgcaccaagtttacctttgttttcagtaccgtcaagctcgattaaaagctgatcgattgcgttttgttcagttacatcaaagccaagaagctctggagcaatgatttcgtttacgttgttaacagctgttaacacgccttttccaaggtaacggtctttgtcgccgtcacgaagctcaaccgcttcgtattcacctgtagaagctccgcttggcactaatgcgcggccgaaagctcctgtttctgtatatacttcaacttcaactgttgggttgccgcgggagtctaatacttcgcgtgcataaacatcaacaatgtatggcatgagttttgtctctccttttgattttcaaattatttttgaattaaagatgttcctgtcatttctttcggtttttcaacaccaagaaggtctaataacgttggtgcaaggtcgcctaggattccgccttcacgcagcgtaatgccttctttcgttacaatcacagggactgggtttgttgtatgcgcagtgtgcggttcgcctgattctgtaatcagaatgtcagcattaccgtgatcagcggtaatgatagcgtgtccgcctttagcaaggatcgcgtcaacgacttcgcccaagcattcgtccactgcttcaattgctttaattgttggttcaaccattccggagtggccgaccatatcagggtttgcgaagttaagaatgatcgcgtcatgcttgtcagcttcaatttctttgacaagcgcgtctttcacttcatacgcactcatctcaggcttcaagtcatacgttgcaactttaggcgagttgatgagaatacgctcttcacccgggaattcagcttcacggccgccgctcataaagaacgtgacgtgcggatacttttcagtttctgcaattcgaagctgttttaacccgtgctgagataatacttctccgactgtgttatcaagatttatcggtttaaacgctacatagccgtcaactgtttcactgaagtgagtcaggcagacgaaatacaggttctttggataattctcgccgcggtcgaagtcacggaagtctttgtttgtgaacgtgttggaaatctggatggcgcggtccggtctgaaattatagaaaatcacagaatcgccgtcttggattttcgcaacaggctcaccgttttcttttgtgatgacagatggaatcacgaattcatcgtagataccatttgcatatgaatcatcaacaacatccagggcgctgcggtaagatgggccttcgccgtacgccattgcgcggtacgctttttctacacggtcccagcgtttgtcgcggtccatagagtagtaacgtccggaaatgctggcgatttcacctacaccgatttccttgatttgatcgttcaactggttgatgtacgttttcgctgtctgcggacctacatcacggccgtcaaggaagccatggatataaacctctgtcagcccttcttttttcgcaagctttaacagtgcgaataaatgattgatatggctgtgcacgcctccgtcagataaaagaccgaacaggtgcaaggctttgttgttttctttcgcgttgctgatcgcgtcaaggaatgtttgattgcgttcgaactctccttcgcgaatggcaacatttacgcgtgttaagctttggtacacaatacgtcccgcaccgatatttaagtgacctacttcggagttccccatttgcccttcaggaagacctacagcctcgcctgaagcagtcaatgtttgatgaggatactggttccaatagcggtcaaaattcggttttttcgctaaagcgactgcgttccctactgtttcgttacgtaatccgaacccatcaagaatgatgagtgcagctggttttttactcatattgaccttcctccaataattgaacgaatgactgtggctcaaggctcgcgccgccgaccaaagcaccgtcaatatcggactctgccatatattctttaatgtttgcaggctttacgcttccgccatattggatgcgaagcttgtctgcagcttcttggctgaagctttcagcgacggttttacggatatgcgcacacacgtcattcgcatctttcgctgtagaagatttgcctgttccgattgcccagattggctcatacgcaataacagaagcagcaacttgttcttcagaaagaccagcaaggccttttttcacttggtcagcaacaagatcatttgttttgccggcttcacgctcttcaagcgtttcacctacacagatgatcggcacaatgccgtgtttgaaagctgcgtgtgcttttttgttaactgtttcatcagtttcagcgaacatttcacggcgctcagagtggccgatgacgcagtagtcaacgccaaggtctttcagagcaaccgggctgatttcgcctgtgaacgcgccgctttcttcgaagtgcatgttttgagcgccgacttttaggtcagtgcctttcacagcagaagcaagcttttctaagaaaagcgctggcgcgcaaacaacagcttcagctttgtctgctgctggaatggaagatttcacttcttcaacgaagctgacagcttcgccgagtgttttgttcattttccagttaccggcgataattggttttctcatctgttccacttccttatagcagttttgagattatttatcgttcagtgcagctacccctggaagctctttgccttccataaactcaagggatgcgccgccgcctgttgagatgtggctcattttgtcagcaaggccgaatttttcaaccgctgccgcagagtctcctccgccgatgacagagtatgtatctttcgcctctgccaatgcttccgcaaccgcttttgttccttgagcgaacaagtcgatttcgaatacgcccattggtccgttccacacgacaagtttgctgtttttgatgacgtcagcatacgtttcgcgtgttttcgtaccaatgtcgattgcttctaaatcactagggatttcagagatcggcacaattttcacgtttgcatcgttagagaaatcatctgcaacgagtacatcttcaggcatgtagaagttaacgcctttttctttagcgcggtccataaatgatttcgcaagctcgattttatcctcttcaagaagagatttaccgacttcatagccaagcgcttttacgaaagtataagcaagacctccgccgatgatcaggttgtctactttatcaagaagactctcgattacaccgattttgtcttttactttcgctccgccgatgatcgctgtgaacgggcggtcaggattggaaaccgcttttccaagtacatcaagctctttttccattaagaaacctgcaactgctggcagatgctcggcaattccagctgtagatgcgtgagcacggtgggcagcaccgaatgcgtcatttacatatacatctgcaagctcagcaaatgcttttgcaagctcagggtcatttttctcttcaccaggatagaaacgtacgttttccaatacaagaacgtctccgtccttcatctcagaaatttgtgcttttacagcatcgccgtatgcttcatccgcttttttcacttctttgccaagcagttcgccgagacgtgcagcgacaggagttaaacgaagctcctcaaccacttcgcctttcgggcggcctaagtggctcgcaagaaggactttggcgccttggtctgcaaggtgtttgattgttggaagcgcagcacggatacgtgtatcgtctgttacttccccgtctttcattggaacgttaaagtcaacgcggcagaatacaactttgccttttacgtcgatgtctttgagagtttttttattcatgcctaggagatcctccttcaaaatggtttgcatacagcacgaaaaacgtgaaaccgtctgttcaagcgataacgccgctagggcagatcgcagtctttttcggcacagggcagttcgtctaaaagccagggcagcggccttaggcgaaagcgccggcaaagctgcttaaaacgcggtcgtttctctatcacagagcgttttctgaaagccggtcttcatggaaaaagggaaagggagtccgtccccttcccttgtccgctttcattatagcgcttctattcgaaagaaccaagtcaggtcctttttcagctataaattaaagacctttttttgcgatgtaagctgcaaggtcaacaacgcggttagagtagccgctttcgttatcgtaccaagagattacttttaccatgctgccttccataaccattgtagaaagagcatcgattgtagaagagtttttgtttccgttgtagtcgccagaaactaatggctcttcgctgtagccaaggattcctttaaggtcgccttcagccgcttctttaagagctgcgtttacttcttcagctgttacttcttggttcagttcagcaaccaagtcaactagagaaacgtttggagttggaacacgcattgctccaccgttcagtttgccttttagttcaggaagaactagagaaactgctttagcagcaccagttgatgttgggatgatgttttcagctgctgcacgcgcacgacggtagtctttgtgcggaagatcaaggatttgctgatcgtttgtgtaagagtgaacagttgtcatcataccgcgtttgatgccgaatttatcgttaagtacttttgcaaacggcgcaaggcagtttgttgtgcaagatgcgttagagataacatcgtggttagccgcatcgtatttatcttcgttaacacccataacgattgtgatatcttcttcgttagcaggagcagagatgattacttttttcgcgccagcttctaagtgtttcgcagcgtctgcgcgttttgtgaagaaaccagtagattcaactacgatttcaacgccttgtttgccccagctaagtttagcaggatcgcgttctgcagaaacttcaattgttttgccgttaacaacaaggttgttaccgtcaactgaaacttcagcgtctaattttccgtgtacagaatcatattgtaaaaggtgagccagcatgttagcatctgttaaatcgttaaccgctactacctcaacttcaggattgtttaatgctgcgcggaatacgttacgtccaatacgaccaaaaccgttaataccgacttttactgccatgattgtttcctcctttaaataagtgagagatatttatattgagggattattcatcccttaataacttctttgcggctccttcgtctgtgacgagaaccgtgttgcgtggctttttaaagtaagcctcgatcgcctcggcttttgatgatccgcccgctaccgcaataatatcggggatggcgtctatgtcatccagctgcattccgacagaatgcactttgtgaaccacttcgccgtccgcgttaaaatagtagccgaacgcttccgtcaccgcgtcgttatcatctattttctttaagtcttctaaaggcgtgtttctgcgctgagccatagttttagcttcgccgattccatgaaccagcatactcgctgatttaatggtgttcagcacctctttgacagaaggctcttcaataatagatgaataggcgccttgtgacagctgtcccggaacaaacaaaagccggtaagtgcctgaagccttctccgccatatgcgcgcatatggtgttcgcctggtttttcacgtcttcgcctaaaccgcctcttgcaggcacaaacaaaagctcgcggtttttagaatccggcgtcatcatttcggcgacagcttcaattgtcgtaccgccagttacagcgacgatatttttgcctgaaaatctttttttcatacatgcgacagccgctcttcccatttcttttttgacccatggggattgatcgctgtctccggatacgataatggcatcctttagatttaaacgttcttttaatgtcttttccaaaagagtcaaacctaaaacatctttcatcgtatcttccaaaacagaaagcagttcatagccctcttctgtcaatgtcatgccgtttgtcttaatatcgaccaggttctgttcctttaaaaactgaacctcgcccctcagcacacgctcgctgatttcgagactggcagacaggcttcttcgcccgatgggttctgtcagcctgatatactgcaagatttcaaacctcttttgcataacgagcagaagatcaggcaataattttttttgagcttgtattaactggttcatgactcaaacgttccttccttttttgctggacgttatatgtcccgctatgacaaaaaacgtcccgtcatagccaaaaaaaatcatttctgctttctttaattattttaacagggtggaattgtttattcaactgttaagagccaattcatcgacaatattcgcagagttttcatgccgcgtcgttttatccagcaatattttatcctatatatctttatcttatacagaaagcgccaaatggtgcatcccaatataaacagcccttcccgtagaaagggctgtttcattaaagcgttttcattttatccaaagcttttcaatttcctcgagcgatttgttcttcgtttccggacagatcgtaacgacaaacaggaaacaaaggatgttaatcaccgcaaagatccaaaatgtataggcgagcccgaaagaatcgatcatcattggcacaaactgtccaatcgcccagtttgctccccataaaaagatggtcgcaatgcccgcggcccgcgcacgcagatggttcggaaagatttcagaaatcataatccatgtgatcggtccgaccgagacacagaaagcagcgacaaaacctaatataaggacgatcatcatgatcccgcttgttaactcaaagtaaaacgacgtcccgattaaaatcataaaaatagccataaaagcagaaccgatggacatcagtttttttcgtccgactttatcaatcagcaacaccgcaataacggtaaagatgacttctacaacaccgacgatacaagttgtcacaaatccggcgttttgcccgaatcccatcattttaaagatttccggcccgtagtaagtaatcgcgttcatgccgatgacttggttaaagagcgccagcaggattccaatgacaagcgcctttctgagccccggcttaaacagctgggagagcgaccccatttgttctatttttaaagagttctcaatgttctttaattcttcttttgcaacagtttctccattaatacgtgtcaggatctttaaagcttcatttgttttgcccgctttcgccagccatctcggactttccgggacgacgagcaggacaaggaaaaagatgacggacggcaccattccataagcaagcatccatctccagccggtgtgcacgccccattcgtatgttccggaccgctgcacagctagattaataaagtatgtagcggaaatacccagtatcgtaaagagctgatataaggaagataaacttccgcgtatggcgggcggtgccgcttctgtaatatacgtaacagagagcgatgagcccatcccgattcccagccccccgataatccttgcaatgattaaggtggacacgtcttgagaaagcgctgaaacgattgctgatatcgcaaataacaaagcggctgtcattaaaatttttctccggccgaatctgtcacttaaaaagccggatatcccgacgcccacaactcctccaatcataatgcttgaaatgacaagtccctccataaacggactcaggctgtataaatctttcagaaaaccgatggcgccagaaatcactgccgtgtcatagccatacaataagccgccaagccccgccgcacatgagatcaaaatgacaaatcccattgaatggcttcgtgttacaggaacatttggttctaattgagttggagtattcttcatttccctgccctcccgaatgttgagtaaagcgttttcatttaaaccttaaattgtacgtacttatattaaaatttaacgaaaattacatttaattagtacgtacaaatatagaataatcttgtttgcattttctgtcaatgttttcttacaaagaacgctgtgatatactgaaatttgtccgtatacattttggaggaatggatatgttaccaaaatacgcgcaagtaaaagaagaaatcagttcttggattaatcaaggcaaaatactgcccgatcaaaaaatccctaccgaaaacgaattaatgcagcaattcggcgtcagccggcataccatccgcaaagcgatcggagacctcgtatcactaggtctgctgtacagcgtgcaaggcggaggcacctttgtcgcttcacgctctgctaagtcagcgctgcattccaataaaacgatcggtgttttgacaacttacatatcagactatattttcccgagcatcatcagaggaatcgagtcctatttaagcgagcaggggtattctatgcttttgacaagcacaaacaacaacccggacaatgaaagaagaggcttagaaaacctgctgtcccagcatattgacggactcatcgtagaaccgacaaaaagcgcccttcaaaccccaaacatcggctattatctgaacttggagaaaaacggcattccttttgcgatgattaacgcgtcatatgccgagcttgccgcgccaagttttaccttggatgatgtgaaaggcgggatgatggcggcggagcatttgctttctctcggccacacgcatatgatgggtatttttaaagctgatgacacacaaggcgtgaaacggatgaacggatttatacaggcgcaccgggagcgtgagttgtttccttctccggatatgatcgtgacatttacaacggaagaaaaagaatcaaaacttctggagaaagtaaaagccacactggagaaaaacagcaagcacatgccgacagccattctttgttataacgatgaaattgcgctgaaggtgattgatatgctgagggagatggatcttaaagtgccggaggatatgtctattgtcgggtacgatgattcacatttcgcccaaatctcagaagtgaaactaacctctgtcaaacatccgaaatcagtgcttggaaaagcagccgccaaatatgtcattgactgcttagagcataaaaagccgaagcaagaggatgtcatatttgagcctgagttgatcattcgccagtccgcacgaaaactgaatgaataaaaaaagcaatgtatgggtctccccgctacattgcttttttttatagctgttatctgttgttccaaacgtcagcgatgatttcaaacgaacgcattctgtctgcgtgttcaaaggtttctgagttaaccataatttcgtcagcctgtgtcgttttgacgaaatcttcaagcttcgccttcacttcttccggacctccgacaatcgtggagctcagctgctcattgaccatcgctttttcatacgggctccagatttgatccatatcctcaacaggcggtttaagctggttcggcgtaccgcggacaagatcaagaaacctttgataatgcgaagtcgcaaggtgctgcgctttctcgtttgtatctgccgcgataatggtgacaccgaccatcgcatacggttcgtcgagcacgtctgacggcgtgaaggaattgcggtaaagctccaatgcaggaaccgtattcgctggtgaaaaatgagcggcaaaggcaaacggaagacctagttcacctgccagacgggcgctgaagccgcttgagcccagcagccaaatcggcacatctatgccctctccgggaatggcgcgaacttgattgcgcacatttcctgacggtttaaaataattgcgcagttcctctaattgttctggaaaatcctccccgctgttgatgtttctgcggagcgctctggctgtcaattggtctgttcccggcgcacgtccaagccccagatcaatccgcccgggatacagtgtttccagtgtgccgaattgttcagcaatgactaatgaagagtggttcgggagcataatgccgccggaaccgacgcggattttcttcgtgcctccggcaatatggccaatcaaaactgcagtggcggagcttgcaacaccttctatattatgatgttcagcaagccagtaacggtgatagccccattcctctgcccggcgcgccaagtccatgctgtttcggaatgattctgcaatcgttcctccctgaacaaccggagataaattcaagacagaaagcaaggtatctttgcgttggttgttagacatattgttctcctttgcaaatgtgttatcagtaaacagcccaaagctgtcaggtcatgattgaaagaacttctatcacaccataacacaactgcattcaggaataaaagaattttattcgatgaaattcgaacaatgtaaaacgaacggtttggcccgctattctgctccaaacagctccttagccatctcaataaagagcttagccgccagagaagcctcctttagcgacggaacagcaagctgcacatcacggtatacctgcgggtccaattcccgggtcaccacatgctccggaagcggcatccccgacatggacatttctgataaaatcgcgagacccaggccttctctgatcatactgatcgaggtgttgatgttatagaccgtgaaagctgggtgcagcgtagcgcccgcctgcctgaacatatcgacaaatggtgattcatagcctccgtcacagacgatcatcggttcatggtcaagatctttcagcgtaatggccgaatgactggcaagcgggtgatcgtccctgagcacgacagccattttgtcttttttcaaatgaatgtactccatctcctctgttggatacagaagaatcccaacatctatcatccgcgtatgaagccactccttgacttcatttacagttccctcgtgcagcacgagctcaagttttggatatttttgtttaaattcactgatcagcttcggcataaaataagccgaggcagttgagaatgtgccgatatggatcgttcccagttcaagccctttttccgctgctgctacctgctcaactttttcaatgccttttaagacttctctaatgtatactaagatctgttttcccgtatccgtcagcatcaggccattgcggcggtcacgaatgatcagctttacatcaagctcagcttcgatcgcagaaatcgcatggctgacagccggctgtgtcatgttcagcgcctgacccgcttttgtaaagcttcccgtttcagctattttcacaaaaacctttaattgtgtaatggtcataacaatttacttatgctccttataaaaaagattcattttatttatcttatgttctaccgtatcatatgatggaaaagttctacaaggagtgaatgaacaatgaagcagctctcaaaaacgcggacagctctcctgctcgcatttctcgtcatcatgtggggcgtcaattggccgctgtccaaagccgcgctcgcctattctccgccattattgttcgcgggcatccgaacgctgatcggcgggcttttattagtcattgtcgcactgccgcgtattcataaattacgcttaaaagaaacgtggccgatttatcttgtttctgctcttttaaatattacgttattctacggcctgcaaacgatcgggctgaattatcttccggccggcctgttttctgcaatcgtcttcttccagcctgttctgatgggtgtattttcttggctgtggctcggcgaatccatgtttgtaatgaaagtgattggcctcatcctcggttttgcgggagtagccgtcattagtgctgcgggctttggcgggcatatttctgtcattggggttctgctggctctcggctccgcaatcagctgggcgctcggaacggtatatatgaaaaaaacaggcagccgcgtcgattccatctggatggtcgctctgcagctgacgatcggaagcgtgtttctgctaatatccggcttttggacagaaagcttttcggcgatccaatggacagctccgttcattacgagcctgctgtttatctccgtattcgttatcgcactcggctggcttgtcttttttacgcttgtcggttcaggagaagcaagcaaggtcgcatcttatacttttttgattccgctcatatcaatcgtggccagctccattttcctgcatgaaccgctcacccttagcctcttggcagggctgctgctgattgtcacgagcatctgtctcgtgaatacaaaatcaaaagcgcagaaagctgcggcgattggtataaacgagaaagctgcacaataataaaaaccctcttgccggatgcggcaagagggtttcttatttactgatgcttgcgtcctttgaccaaatatgcaactgtaatcaaaaggtagatcgccgcagtaatgccggtaatgacaattgatgttgtcatgatgaccccgatcagaatggcgagtaatgccacaatcgcaaaccatgtcgtgtacgggaaccattttacataataggccggtgtttccgtttgctgttttctcgattttaaatgagcgaatccgatgatcagccaaatgaataaaacggtatatcccaatgatcccattaaataattaaatgtttggcttcctgcgaacagagaaatcaatacgccaatatagagagaagaagtgcacatcagaatcgcaaacatcggtacgtttttcgatgaaagcttcgagaagacctttggaagccttccgtcacttgcctgtgtatacaaaatgcgtgatgatccgtataaacctgaattcatagaagaaatgatcgccagcaggatgactgcattcatgatatgatccgcgcccggaatgcctaccattttaaagaccatcacgaaaggactttccggaaccgaattgacttggttccatggaatcaggctgacgatgatgaaaaacggcagcaggtaaaacgcgacaatccgtgtcagtgtgctgcggacagctttcgggacaaccttttccggattttttgtctctgcaagcgttacaccgataatttctgtaccgccgtaagagtagatgacgacaagcatcgccgtgatcagccctgtgccgccgtgcgggaaaaatccgccgtggtctgtcaggttggaaaatccggatgctgtatgatcaccgaatgatacaaataagagcagcaatcccagaataataaagataataataacggtaatcttgatcattgccagccaatattcggtttcggcgaagattttaacagaaagcaagtttacaatcgtgacgataagagaaattcctaatgccaacacccagatcgggcagcccggcagccaatattgaatgaaaattgcagctacaacagcttcagccgcaatgttgagcacccacattttccagtagatccagtccaaaagtaagcggcgtaatttcccaatacctgttggacaagatcacggaaggttctggcgttacggtttcgaacagccatttccgccagcccctgcataataaacagcaaaataatcccgccgagcagatatgcgagaatgacagatggccctgccacatcgatcgctgagctgctccccttaaataaacctgcgccgattgctccgcccagcgccatcatcataatatggcgggacgtcatcgtgcgttttaacgtttgattgtcgtttttcatcctcttctacctctccttctcgttttcaaaaacaaaaaagcccgccgtctcctacctaatctaatagataaagagacgacgagccttcggctgaccgcggtaccactcttgttgattcttcatgaagaatcctgcttttgacctgtaacgaaggttagccgttaaaacatagggaatattcaatctattccgttccgtcttaccactcccgggcgagttcaaagaagaatcaggctgcgtcgcaccaccccgcagctctctgttctgatcactttcttttactgctcccaatctatgtgttttagttttctgaaaaactcaaattttatgatctgaatatattaacataatatacgtgcttctcttttaactgtcaataacttcagagaaaaaagaaactgttattttgtcccttttcgaatggctttccaaaaggattctgactcgtttcctaatgcgtaaactgaaacacctgctattttatattgctttgccagatggcttttcgtttgaacggttttttcgttttcataccacacgacatgtttatgcttctttttgtcaacataagaaaacgtcatcgagcctgattttttgttgaatgccggctttgctttttgttttttgatgagggatttgagctcattccattcccttattgtgctggtacttccgtcttttacatcccagtcatagccgtacgcagggattcccatgatgactttattggctttgatctttttgactgaaaactgcagagagcttttgatccagtttgtgcttgccactgaccccggctcaccccaaatgccgtgttcatcgtaggtcatgacttgtacgaagtcggcatatttgccgattttcgcataatcatacggccagctccagtcatcatttttatcatcggcgcttttggccggaacggataccattgttttaatatgtttcttattcaaagcctgtgagacatattgaatgaagttcgagtatgcagcgcggtcttctggatttactgcttcaaaatcgatattgattccgtaatatgagtgctttttggccagtgtaattaattgatctgtgaatcgttttttcgctgttttattgctcatgacccgactcgctaaatctccgtcaaaatcataaatggcatcattatagtttgaaatgacagcccatgtcttgatttttttctttttcgcatatgtcagctgcttagttggggcatcgccaatgatttgtccgtttttttcaaacgcaaatgtatcggttgcgatggcattcatgtatgtatgatatttcgtaagagaattgtatgaagccgtatccccagtcgtgtagcctactgtcataccggctgccttcgcttctccttttgtatacataaacagaacaatcgcaatcgccagtgaaaccgctatgatcagccattttttcattgcatttcctcctgtatcaagtcatactcttctcatcggccaaaaaattggaagttgaagttttttcaagcaaaaagcccggcatatgcctgccgggcttcctgagttcagcggtcagagacgagaatatatgctgcctttactggtccatgcacccccacaactaaatccatttcaatgtcggctgagttactcggtccggtaatgtagttgatacatgaaggaacagtgacaccgttcgcaatgttttggcggatgatatcactggcttgtgtcattctcggtacaatgcttgatttcggcacgatcgcaatataagtcgttggcaaaaggctgacagagcggccgatgtcttttgaggagaagaggacaaccgtccccgactcagccaatgtaatttcgctgaatgtaatccctacattggcttgctccgcttttttaatattttcctcgcctttgtcagcatcccactcccagaccggcgttccttcactcggccagtccttggtgagcaggcttttcagtccgtattcttcaaagcgggggtccttcggaatgatgacagggcctccagaaaagcggctgacttgctcgcgcagggcatcgtaaaggccggttgaatccgtttcaatcagctctgtatggattttgacgcaatggtttttgagcactgtgactaagtcatccgctgaataaccttcaagtgttttatattgcggctcatacgcccattcagggactgccacgcctcctgttcttctttcacggcccaggctggatgcgattcgatttaaaaagctctcttgattctgaatggttcccttcgtcatcactgctcctccttcgtgcgttcacttgtttctctgtccgcaaaccagtctctgaatctcgatttatgcggtgccgggaagtcacggatctgggtccaatttttaagcgggccgggccctttcgaaattttttcgtcctctgtaaaaggcgtcatggcggccggcgcccattttgagcccattttgtaaagcgataaagaggatgcgccaagtccgaatgctttcattgcaagcttttcactgatcggcgctctgccttctttttcgacgatattctgacgatgcttgagtagcagctcatgaagcgggattttgaccgggcaggcttctgaacaagcagcgcacagtgaagacgcgtacggcagctccttataatcgtcataaccgccgagcaacggcgataaaaccgctccgatcggtcccgagtagattgagccgtatgaatgtccgccgacatggcggtacacaggacagacattgatacaggcggcacagcggatacattgcagcacagactggaattccgttccaaggatattggatcgtccattgtcaacgatgacaagatggaattcttccggaccgtccacttcaccttccagcttcggacccgtcaaagctgtaatataacttgtcagccgctgtccgacagcacttcttgtcagcatgctgacaagcacttcaaattcagaaaatgacgggacaatccgctccattcccatgacggtaatttgtgttgtcggcaaggtgctcacaagccgtccatttccttcattggtcacaaggctgacagaacccgtgtcagcgatggcgaagttacagccggtaatgccgatatccgcttccagaaactttttccggagaatggcgcgcgcatgcatcaccagctcttccggtttttctgtatgttgatagtccagcctttctttaaacacatcgcgtatctgctctttatttttatgaagggcgggcgctacgatatgtgacggcggatcgtgatcatcgatctgcaaaatatactcgccgagatcggtttctacgacttcacagccttccttctccagcacctcattcagattgatttcctctgtgaccattgatttagatttcacaattttcttcccgttcttcttttgaatgacatcacgaatataagaagacgcctcttccgctgtttccgcgaaatagacatgtccgcctcttttcgccacattttcggcaagctgtccgagatagaaatcaaggttttcaaggacatgctgcctgatttcctctgataatgagcgccactcctcccagtttcccagttcttctgctgcctctaggcgccgcgtccgcagacgctcctgtgcacctgaaacagcgcctctcataaattcattatcaatcccctgtgatacccgctctttaaaagcgtcagtaccgattttcatcgccatgatcctttccccctctgaatccagttttatctgctgttgagcacttcggcgatgtgcatcactttgacattcttatcttttcggccaagccgtcccccgatattcatcaaacagccgcagtcagcaccgatcagcacctctgctcccgtttcctccacacattcgactttttcatcgaccatctgctcagaaatctgcgccatcttgacggagaacgttcctccgaatccgcagcagttatgtttgcccggaagctctgtaaactgcaggcccttcacatggctcaacagcttcatcggctcctcccgaacacccagcagcctagtcatatggcacgacgtatgtaaggtcgcttttgtatgaagggtcgcgccgacatcctctactccaaggacgttcacaataaaatctgtcagttcatacgttttatccgccagctttttcgctttatcggcccatttcggatcatcctgaaacaggtgcggatactcccggaacatcgttgtacaggaaccggaaggactgacaacatattcggaatcctgaaacgtttcgatcatccgtttcattgcttttttggcgtcatgtacatagccgctgttgtatgccggctgcccgcagcaaatctgcccttccggaaaatcaacctcgcacccaagccgctccagcagctcaaccgttgcttttccgacatttgtttgaaacatatcaacaagacaagtgacaaaaagtgagactttcatgatgaacccctctctcatccccaatatatgatcaggtcatctgatgacctgagttaaaataactatatgaatatcgtacactattctgacaatggaaggaaagagttttctagggatattttcatttgtggcatatcaaaaacactcccgatctcccaggagtgcagtatatggttaaatccagcccttttcctcagcgatgctggcggcttctgtccgatttttcgcattaagcttttggatgatttctgagatatagtttcgaactgtgccttgagataaatagagctcaagcgtaatgtcttttgttgtcttgcctaaagccgcaagcctcagaatttcttgctctctaacggttagcggattttcgtctcgcatcatattaaacgtcagctcagggctgaagacacgttttccctttacacattttcgaatggcatcggccagatcgtcaatttcgccgtctttcagcagatacccatgtgcaccggcctttacggcgcgttcaaaatatccggggcgggcaaaggtggttaaaataatgaccttgctgacgcagccttttttcattaattcctctgccacatccagcccgcttcgaaccggcatttcaatgtccataatgcatacatccggctccagcttcaaaatagcatgtagcgcctcttccccgttcaatgcttgtccgatgactgtcatatcctcttctaaatcaagcaaggatcccaaagcgcctaaaagcatgcgctggtcctcagcaataaacagacgaatcattcttttcgtcctccaatcattctgcttttttaataagcggaatcgtcagtgccacaaccgttccgttatgatctgaaaccgttaatcccccttcaatgagcatgagccgttcttccattccccacaggccattcccaaacattttctccttcggcgctccctttccgtcatcccgtattacgatcctcattttgtcagcaaattgagaaatggtgatggcacagtgggttgctttgctgtgcttgataatgttagtcacggcttcccgcatacacatactgataatattttgagtgacgggagatatcactgaaaagtcgtcggctccttcgtattgaaaggtaatgttccccgctcttaatatgtgctgaatgtttacgagctcctctgttatcgtgaccgttctcatatcagaaaccagctctcgaacttgcttgagtgcggagcgtgaactggtttccatttcttttgcctcaagcttggtccgttctggatcagatgcagacagccgctgaatgagctggctttttaatgtaagcagcgacagggtgtggccaagagtatcgtgaagatcacgggcgattcgaacacgttcctcccttttagagagttcttttatctgttcgttggcttgtgcaagcttagcttcaagctcaatcctccgaaacatagaacgaattccgaatggagaaatgagcataatgacgagaaacgggagaacagaaaaaagctcccgaagcgagaccgaattcgcgataaattggtataggcatggaaaaagcagtataaagattaaagcgcagaacgcacggttaaaattcgttttctctttgtaataaccaacaaagtttgccggaaaaaaacctaagtatatataggtgatattgtaaaacacactatacatcaaaataaccgccatttgcacgataagccaatatgtaaacgaagctttgcccacgctgcagaataactggcgatatgccgctacaaaaaggagcagcataccatatccgatcccctgtttgacccctgattcttttaataaagagaggaacggcataatcgtatacaccagaaagatataagggaaaaacccgaattccttcgggaaaatagatattgcctttttcatgtattacaccgcttcttgttttcttcttatatatttagatagtagcatgaagagcatcatataagcgattaatatcagaatatttttccaagtcggactcccaccccggacaagttcccacgctccgctcccgaaatgataagacggaagccactggccaatgctctgcatcatgtcaggcatgacctcaaacggcatccacatccctccgcctaaagccagcagcatataaagcacattactgattccggccgctgtttctacttttctcatgaggccgattagtgtgcctaatgctaaaaaaggcaatgcgccaaacaaaatccacagtccgctcatcatccattcaaacggtgacaaggcaatatcattgatgattgcgccgaacagaaatatgacggtaattgataaaacgtgaatgacactttggccgatcatctgagctgataaatagatatgatccggaagaggcgtaaggcggataaaggcggtccagccttgtgaccgctcttgtaccattcggatgccaagcgtcatgatagaggaacccatcacgctgaagactgtcatcgacatcaggtaatgggcttcccatgcacgttgatcagggacgttggtattcactacatttgtaaagaaataataaaaggcaatcggcatgatcagagaccaaagcacaaagtacttgttcctaagcacccttttcatttcagcgatgctttgcttttgcagcacgttcactcacatcgcctccctgttgccgtcagccagctggcgaaatgcctcatcgagcgttgcttgctcaattcgaatatcccgtgcatgtatgttttcttgaaagatcagcgccaacactttgtctgtatttgatgtctggatgatggttctctcatgctcgtggatcactctctcgacttccgggtgacaagacagcctttccaatgattcacttgaatgaagcgtaaaggaaacagactgtttttgaattcttgagcggatttgcattggtgagccgtctgcaacaagctgtccttcagtaaaaaataggattcgctgtgcggcatcatctgcttcctgtaaataatgagttgaaaaaataatcgtttttccttggtccgacagtccgtgaatggtctgccagaatcggtgtcttgatgaagtgtccatgccgactgtcggttcatcaagtataagcagctccgggttcccggcaagagccaaagcaaagctcaaacggcgtttttgtccgccggataatttttctgctcttgttttcaaatcttctttggtgagtgctgttaacgaaacgagttctttcatggacaatggattcggataatagctccggaagagttcaaggatttcatccaccttaaggcccggcatgacacttacttcctgaagcattacacctattttttcacgaacctgttgatcatcgggaacccggttaaatagtttgatttctccctcactcggtttcagcaatcctaatatcatcgagacgacggtcgtcttccctgccccatttggcccgagaatggctgcaatttctcctttttcaatactgaagctgatgtggtttacagcggtttttcgctggaaatgttttgtcacgttgcttactgttactgcttctttcatcacatgagcacctcctgatcgtttacattgattgtaaaatgacggagaagacgatgttagtatggggtgtcatgatgatggagtgacaaatgtcatttttttctcaccccggtgtctaggcaatcctcctcctgcatcttccaattcatccatcttttctatctcccatgtcctctttcttttaaactgctgtgacattcatagaaagatacactcttcaaaccatccgagtgttatgatagaaatattgaactttatattactttccggctgaaaggagccaatcatgaacgaagcgattttgtctagaaatcatgtgaaggtgaaaggcagcggcaaagcatctatcatgttcgcacctggttttggatgcgatcaaagtgtgtggaatgccgtggcacctgcctttgaagaagatcatcgggtgattttgtttgattacgtcggttcgggacattcagatttgcgcgcatatgacctgaatcgttaccagacacttgacggctatgcccaggatgttcttgatgtttgtgaagctttagatctgaaggaaaccgtgtttgtgggtcactccgtcggggccttgattgggatgattgcatccatccgccgcccggagcttttttccaatctggtgatggtggggccttctccttgctatttgaatgatccgcctgagtattacggaggatttgaagaggagcagctccttggcttgctggagatgatggagaaaaattatatcggctgggcaactgtatttgcggcaaccgttctgaatcagccagatcggcctgaaattaaggaagagcttgaaagccgtttttgttctactgatcctgtcattgcccgccaattcgcgaaagcggcgtttttttctgatcaccgagaggatctttcgaaggtaacggttccctctcttattctccaatgtgcagatgatatcatcgcacctgcaacagtaggtaagtatatgcatcagcatctgccttatagcagtctgaaacaaatggaggctcgcggacattgccctcatatgagccatccagatgagacgatacagctgatcggcgattatttaaaagcacacgtgtgatataggaacgaaagggatagaggtgaccctcttagatggacaaacaattgaatgatgcaccatgcggtttcctcgctttgtcagaagaggggtcgatcatagctgccaaccgcacccttatcaagattctggattatgagccggagcaggttatcggccagcatatgaatatgatgttgacaattcccgcacagcttttctgccagctttatttttttccgcttttgaaattggagcatcacatcgaagaaatatacatttccctgaaagctagagatggagaagaaattcccgtccttatcaatgctattgcgagacacgatagcggggcttctgtctttgattgtgttctgattccaatgcgaaagcgaaatgaatatgaaaatgagctgctgatagccagaaatgaggctcaggaagctttgcttgccaaacagaaagccaatgcggagttagagattgccttggaaacgctgaaagcaaaacaagaagaacttcttgagatcaataaacaaaatcaacaatttaaattaaacaccaaaagagagcttgaactcgccagaaagatccagaaaaactcgttgactgaaccgattgtaaacgatcaggttcagattgactcttattacaacgcatcgagtgaattgtcaggtgatctttacggatattatcaaatcgatgaacaccgttacggcattattatccttgatgtgatggggcacggaatttcatctgcattgattacgatgtctcttcatcctttgttccagcgccagatcacgcaaggtctcagccccgttaaagttatgaaggaattggaccggcaccttcacagcttgtttcaaaatgatgaggaagcaagacattattgcactgctatttatctcgagattgacatagcacggcaaagaattgattatgtcaacgcaggacatccgccggcactttggcaggacgatagcggaactcaacatctgcttcacgcgacttcgcctccgatcggaatgtttgaagacttagtatttcagtcaagcagcctttcatacacggagggcggaagattgcttctgtatacggatggcgtgatggatcctacggcttcatgttatttatatgatttactaaaggatcatcctgattcgccgatcgctgaccagaaggagaaaatccttacatcactgcagcatcaaaaggaagctcatcataagagtgatgacgaatgttttatattagttgatgtaaaataaaatgatccatgagacataacaatgatttgttacatctcatggattttttgtttcagcgtttctttggaatatgtcctgactccgcatattgaaacacctgcaaggaaggcagcgggtgtccattaaaatcaaataaagcttgattatctacagcacttcccccataccacttcccggcgtcttcagggtcgtattcagcagcatagctggacgcccaccctgacccgtatgtttcccataacactttgtttttctctatctgtgttttcggtccgaccggaatccacgcaggctcccagtagaaaacaccaagtcctgctttgcccgtattcgccactgcctccattacatctcttactgcagttgcctggccttgaacagaaattggatatggcagcgtctgcccgctttttggtgctgtatttccatgcccatcgccatcctcggcggtataggtgtacgatgtctccgccaccatgacttttttgccgtacgtgttggcaacagccttcagcacggaggtcaaattttgtaatgtgccatgccagaaaggataataggagctcgcaaacacatcataatccactttgtttttgctgagtgtttccgcaataaatgaataccttccagccgtttcaggattggtaaaatgcagggcgaccaaaatatttgaatttgtctccctgaccgctcggcttccttcattaaataattggcacatcttcgtccaatcagtctcaccggcaaatcctcctgttgtttcatttccgacctgaaccatgccgatgtcaacgccttccttgatcatcttttgcaggctttgtttcgtatactcatagagctttgctttttttgcttcaaagctgagattcacccaggctttgggcaccttttgtttcgctggatcggcccagaaatcagagtagtgaaagtcggccagcaccttcattccgttcgctgtcgctctttttccgatttcgatggctttttgaacatcattgtttcccccgccatacccgttgccatttgaatcatacgggttattccagatgcggacgcgaacatagttgaccccagcctgttttaaggttgtaaagatgtcctgacgttttccgcttgtattataaaaggtgacaccgctgttttccaaagcaataacgctggacacatctgcccctttgataaaatccttgttcatcccctctacttttttaacaaaaagatcctctgtccgaagctctgacacgtgcttgtccttctcaatggcagcggcatatcctgttgaactacatgcactccacacgatggcagccgcaaagaacattttcactttgcttttcatgatttcatccccccaagacttagtaagcagtttcattctatagaaaaaagaatccgcccatatcgagcggagcatcagcctaatgtgtgtttacgacaattctcacttcatacttttccatcgtcaggtcgcctgacaatatgtctcctgtcattatgtccttcacactctgatcaaacgtgaccagttgtttttcttccgtaaagttcatcacaaaaatataatcattgtcctgatcctgcctcgcttgtacggagacgccttttccgtgccgaaccggaaaaactggagaaagagacaggtctgtgatcagaccctcatagaaatcacgctgaaattgatcctccaaacgcgcgccgataaaatacgccttgccctgctgatactcatggcttgtgaccgctggcgtgcgcgcataaaaatcttcttgatacactgcttccactgaagctgtctttacatcaatcacggttgcataatccttcatttcatatatttggctgcgatagctgacagcgtttcgatccttcggatacagggtgtccgtttcaagaggctcaactccaaatatagcttgaaggtccggatgccatccgcctgtgtatgttaagtcatgctcattcacaaccccgctgatatacgtcatgactaaggtgccgccgtcagccgtaaacgcttttaaacgggaaatggtgtcctcgctgattaaatacagcatcgggacgatcagcagtttatatggtgaaaagtcttgttctttcgtgatgacgtcgacagggatatcgtgttcccagaatgtgcggtaatgctgctgaagcgtttgcggataacgttttgtcgccttcgcaaacccctgagcatcctcgagcgcccaatgattttcccagtcatataaaatcgcggtttgagccggcctcttcgttccgacaacttcggacagccgttccaatgtctcgcctaccttggccacttcttgaaagacgcggttctttgggctattgtcatgatccacaaccgctccgtgtaatttttctgatgacccccgtgatttgcggtattggaaatagagtacgctgtccgagccgtgggcaatcatttgcatggatgacagcagattcatgcccgggcgcttcgccttgttgacgttatgccaattgaccgcgcttggcgtacactccattaataagaaagactgctgcttcaagcttcggtacaggtcgttgataaaaccgaccttcatcgctaaatcagctgtgctttcccagtcattgtgccagacaggataagcgtcccagctgatgacatcgacatgctttgcaaatttgctgtagtcgaggccctgatacgggatcaaatccggtgtgtcagccataaaattcgttgtgatagggatatcaggcgtcagttctttcagcggaatgatttcatttttataaaacgaaatcgtttgatcggtgacgaaccggcgccaatctaaattcaggccatgcaagccattttcaccgatcggcgaagggctttcaatttgtgaccagtcattgaacgtatggctccaaaaaggagtccaccacgcatggttcaatgccttgaggctgttgtcatatttcgatttcagccactcccggaaagcatgctggcataaatcacagtggcaatctcccccgtattcgtttgaaatgtgccacattaacagcgccgggtgatgtccgtatcgttctgctaataagcggttgatgtgccgtgttttttctcggtagactttagatgtgaggcagtggttgtgccttccgccgtgcagctgtttgacgcgggaggcattgacgcgcaaaacttccggataggtttgcgacagccaggccggacgggctccgctcggcgttgctaatatgacccggccgcctatactgtgaatccgctcaaaaatatcatccagccattcaaattgatatacaccctcctccggctcaagtgcgctccatgcaaaaatgccgacagaaaacgtattcgtatgagaaagcttcatcagtttgatatcgtcagctaaaatatcgggccgatccagccactgatcggggttgtagtctcccccatggagcataaatttcgcttcggttacgtgcgttttttcaagctttgacatcacattctcctcctttttctcttagcccttcgttccgcctgcggttaatccggacacaaaattcttttgcagcatgataaagatgagggcaaccggtatgctgataagcagggctccggccgcaaatgtcgtatagctggcccccatgacatcattcactaaattgaatagaccgacgggcaatgtatatgattcaggcgttctcaatatggttgaggacagcacaaaatctccgagcggaccggtaaagccgttcatggccacgactgccgccatcggttttgataatggcagaatgatctggaagaagattctggtgctgctggctccgtcaatcttggcgctttcgtctaaatccatcggaatggaatccatgtaccctttcatcaaatacgtattcatcgggatcaggccgccgatataaagcaagattagcagccagtggctattgatcattcccaagatttgcgccagcacaaacaaggcaattaaagccgaaaactgaggaatcatctgcagcaataaaaagagcgttaaagcgtatttcctgcctttgaagcgaaagcgcgaaaacgcataggctgtaaacgtcacacagagcaaagaccctgccattgtaaacaggctgatcttcattgagttgacataccactgcacatattgaaggctttctttgcccgcaaataattccttgtaatggtcgaatgtcggatgcttcggaatgatggatgtactgattaagctgttgccagggttaaagcttgcgcctgccgtccaaaggagaggataaacaatgatgaccgccataaaggctagcaacaagtaagagaaaaggagacggatatattttctgactttcatatctgccagcataccttatgccccctctttaaaagactttgtctgtctgaattgccacaatgcgatggagataacaaatacagataataaaatggttaaagccgcagcaagagaatattggctggactgcattgtcaatttataaatccatgaaacgaggatatctgtcccgccggctgttgatccggttacagccggacctccgccattgaatagatagataatattaaagttattaaaattaaacgtaaactgggtaatgataatcggagccattgcaatgaacaccatcggaagcgtgatgtatctcagctttgaaaagacagaagcgccatcaatcgtagctgcttcatacagatcgtccgggatggattgcaatacgcctgttgagacgagaaagatgtacggaaatccgagccagccctgcatgagaatcaacgcaagcctcgaccaattggcatctgtcatccacggaagcggatctatcccgaagaaagccaagatgtcgtgattcatcgcaccgaagctatcattaaacagtcccgcaaaaattaaaatcgtcacaaaaccgggaacggcccatggcaaaatcagaatcgtccgaaaaaaacgtttaaaccgaaggtctttctggttaacaatgatcgcgagaaaaatccccaagctgacttgcagtgtggatgcagcaagtgtccaaaccaccgtccaagccagtacatcaaaaaaagtcgacctccaaatatcaactgtgaaaatatttgcgaacgtttgaaaaccgacccaatcaattaattttgcaggaggagaatgatacaaatcatagtttgtaaacgctaatgcaaagctgaataagataggaaagatcacggcgaaaattaaaataaacaaagaggggccgctgacgacataaggatagccctcagaaatgatatgttggtattgttcctttaaggaacttaatggcttattttcatcacgctgttttccgctttggaacgcatcgcgaagattcacataatacaccgcaaggccaaagcaggtcacgatgacagcgataattccttccgccagcagaaaaacggaattatcccgcggcacttctgttcccagtgtaaagattccccaaaaccccatattgagcagatctccaaagaccgcaaaaaacgatgcgcctaagaaaagaaagacaataccttttatccattgcttgttataaaattgcccgagtcccggaatgatagaaagcaacaaagcgacttgacgatgctgcaccgttttcacctctcttacaatacaaatctagctttctctttattttccgctgtgctttgccttaatttgtcctttggccgtttcagctgcttgatccaatgcttgtttcggatctgccttccctgttgcaaccgtctgtaatgctgaatcagccggcgtccatatttcattcatttccggaatatttggtgttggctctgagaaacgggattgttcagtaacagcccgtgccgcctcgcttttcataatagccgggtcattggctagggatttcacagcaggaacttctttcgtttcttcatatcgtgttttagaatttttttcatttgccaggaaaacggctaattcttgcgccagttcttcattctttgtaaatgcactaacgttgtagcttttgacgccgataaaggagctcatgtttttcctattttccagcttcggcagtttcgtaatgccataattgattcctgctttcgaaaaagcttctacattccatggaccagaaataattgcggcggcttttccttctgtgaacagcgattccaatacgttaatcccttgttctccaataatgccagccgggaacaggccatctttgtaaaacttctgaatcagcgccgcacctttgacagctccttcattattgattccaatgtctgacgggttatagctcccatctttgtcctttccaaaaatgtatccgccatatccgctcatcacactttctgcataataaatttgatcgaatagggctaaaaagccaaaattgctgccatcagctgtctttttggaatagtcgtaccactcttccagcgttttgggcaattccttttctgtgatgagatctttgttgtaaaaaagcacagtcgtttcgaccgcttttggcagtccataaagcttttgatctaccatttgagactgaatggaagcgtcagtataaagtgattgaacgtcttttttgacatgtaattccttgagtaatccttccgtgacagcggttccgatttggtcccctggcattgttaacacgtcagggcctgtgccggccggtccgtccattcgcaaatcttcaatctgcttggcatacggtttttcaacgactttgaccttcacatcatgctctttttcaaacgcagcaacggcgtctttaatgccgatgctcttttctttatcctcccatacaacaagctctgacccttttgaactcgatttggcgctgctgctttcctttgggccgcaagccgccaaggataaactgacagctgcgcagagcatgaatacggaacacttttttgccattttcattgattgtcaccctttcggtaggaatgaaagcgctttaaagataatatagcacgcttgagaaaatgtgtaaacaaactatttacctcatagagtaaatttttttacttaaataaaaatgacttagtgtcctaagtcattcttaattcatactcttcctgacgattaattctgcgcccacatataatgtttttaccgttcttctcttgtcctgcacttgttcaagcagtaattgaacagcgtttttacataattcatgtatatcaatatgaaacgtcgtcagaggaggcgagacatacttcgcgaagctgatgttgttgatactcacaatgcttaccctgtttggtatagcaattcctttttcgttcagggcttgcagacagcccactgctatcgggtccgctgcaatcataaaagcagtcggaagctgatcgcctaatgtgtcgatcgctgctgacatcaggcggtagccgttttctacagagaatccgcgatgacagaaaatatagcgctcgtccagcatggctttttccctcatataggatctgaaggtttgttcacggatgtccatttcatcctgattggtattcggatttttgtatgtgccgccgataaaaccgatgctcttatgccccttctcagccaggatgtttaccgtcttccttgtcatttgtgccaaatcgggccttaccgagtcaaaatgatcgggatcaggagttgaatcgatgaacacgccgttttcagtgagatttctgaggaaagccagctcttcatctgaaaatgtgccgacggcaataaacccttccgtatgttcaggaatgctctcgattccatccgctattttataagtggtcatatcgacattgaatgctttcgccagtttctctacttctaatctcatcgttttaaaatagacatcttctaattcttctttatctgtcagccaatataaaaacgcaatatgtttcaccagcggccttactgtttttttgcggtaattgagcttttccgccgcttcatagattttctcccgtgtttcatcaggaacagaaaggctttcatcgttatttaaaacgcgggaaacggttgagattgaaaatcccgcttcctgcgcgatatctttaattgtcgccattgcatctgcctccattattcagctcgcattgttttagtaaaatattttactttctttttcgcaaatgtcaagtgcacaaagccctctggctgcctcatgtaaaaagactgaaccatttgcggctcagtctcagttgttcgtatcattcggaaccggcggaattgcccgggaaatgagttggttattgcacattttcctcgaaatatcccgaaagcacatcttccacattcgtcaaatgcgccagcatggcggcttccgcctctgcaccgttcccggcagccacagcattgtaaatccgttcgtgctcctcatacagccgctgaacggaggtcttcttggaaaacagccagattttcctcgtttccctcattgtttccagcagcaatgatgacacgtgattcatcaagtgtttaagaagttcattttgagaagcgtccgcaagcgcaagatgaaatgcaaagtctgctttctctcccagctccccgtccgcttcaatgctgcccatttccttcagggcatcatgaattctttcgagatctgcttctgtccttttttcagccgctagtgaagccacgccgatttcaagcagttttctgacctcgagcagctgcttgacgtcctcttttttcatcagaagggcggctgagagcggctgagaaatttgattgagctcaaattccttcagatacgtgccttctccctgtttcatttcgacaagccccatcgcttttagcgcagaaagtgcctcgcgaaccgctgaacggctgacttgaaagctctcagcaagcgcctgaacagagtccagtttatcccccggcttcaattcgccgtttttgatcatatctaatagtgcatccgctacttcttcatatattttttttgttttaatctgtttgtatttcaatgcaattcaccccgtaacttgtaggtctggctgtttacgatctattatactctgttttgtgggccgccaaaagattttgactattttgtcaaaaagtcttgtactttgatttttttcaaaatataatgctaggtaactggtcttattacccagtcatcagatgatcatatcatctatagaaaccgcttacatatggcgccagtttatgtttcaaggaggggtttgggatgcaatggacacaggcatatacgcctatagggggaaatttgctattatcagcgcttgccgcacttgtaccgattattttctttttttgggcactcgcgattaaacggatgaaggggtatacagcaggcttggccacattggggatcgcccttatcattgctgtattggtttatcggatgccggcggaaaaagcgctgatgtccgcgacacaaggagccgtatacggattgttgccgatcggctggatcattgtgacgtctgtttttttgtataaaatcactgtgaaaacgggacagtttgatatcattcgcagctctgttctctcaattactgatgaccgacggcttcaagctctcttgatcgctttttcattcggggcttttttagaaggggcagcaggcttcggagcgccggtcgccatttctgccgcgctgctggtcggtctcggctttaatcctctttatgctgcggggatctgtttgatcgccaatacggcgccggttgcctttggggcaattgggattccaattacagccgtagaagggccgacagggattccggcgatggagatttcgcaaatggtcgggcggcagctgccgtttttatccgtatttattcctctttatttaatcatcatcatgagcgggttcaggaaagccttggagatctggccggcgattctcgtatctggtgtttcctttgccgttgttcaatatctcagttccaattttttagggcctgagctgcccgatgttttgtcagctcttgtttcaatggctgcgcttgctgtgtttttgagatggtggacgccgaaaacaacattccggtttgccggtgaacaagagtcggccgcctcaattgaaacggcgcgcacaaatccggcggcgcctgcgtacagcggcggacagatttttaaggcttggtcgccatttctgctgctgacggcgatgatttccgtatggggcattccatctgtcaaatccgcgctgaccgggcattatgaaggctctgcggtgttcttaaagtggctgaatgctgttggagaaaaactgactttttccccaggtgtgccttttttgaacaatcagattgtcaatgctgacggtacaccgattgaagcggtttacaagttggaggtgcttggttcggccggcaccgcgattttgattgccgcagtgctgtcaaagttcatcacggcgatttcatggaaagactggggaaccgtttttaaagaaacagtccaagaattgaagcttccgattttgaccattgcttctgtcgttggttttgcctatgtcaccaactcctcgggaatgagcacgacactcgggatgacactcgcgctgacaggttcgatgtttaccttctttgcgcccgttctcggctggctcggcgtcttcattaccggctcggatacttccgccaacctgctgttcggcaacctgcagaaagtcaccgcattatcagtcggcatggaccccgttctgtctgtggccgccaactcttcaggcggtgtcacaggaaaaatgatttcaccgcagtcgatagcggtggcgtgcgccgcggtaggactcgccggaaaggagtcagatcttttccgctttaccattaaacacagtctgtttttgctgctgctcgtttgtatcatcacctttttgcagcatcacgtattcagctggatgattccttaaaaaaatcctcccgtctagggaggattttatttatatcgctttctcgctgccgatgacggaatattcatttgatcgcgatattttgccacggtgcgtctcgagatttggatgccgtgttgttcatacagcaaatcgacaagcttttgatctgaaagcggttttgttttgtcctcttgattgatcaggtcttcaagatgcattttgactgcataattcgacgcatctccctctcctgaagcctcggcttttgctgagaaaaagagcttcatctcaaacagcccgtaaggcgtttgtattgttttccctttaatggcccggctcacagttgattcatgaaggcttagacagtccgccacctctctcagagtcagcggcttcattgcgcttcgccctttcagaaagaaatccttttggcgtgtgatcagttcattgataattctcgtgattgtctgttttcgctgcctcagcgcgcggctcagccagcgccactcctgatatttcgcagataaataggagacagtatcctgacaggagccggatgataaaagcgttctgtactgcggatgcagatcgatctcgggaaacgagcgggtattcagttccgctgcgatgtgcccgttttttacagtgataaaaatgtcaggctcaatatacacatcttgctctggccgggcaaacagaaggccaggtctaggatgaagagccgcgatatcatctgagatatcttgaatagtatgaagcggaattcctgcctccactgaaagcgctttccattttttttgcgcaaaagcatcaaaatgagctgaaaccagcatttccgcttgttcatttctgttcggcagccgctgtaattgaagaaggatgcattcctgcaaagatctcgcgccaattccagccggttctaatgactggagttttgccaaaacagcctccgcttccttggccgatacagataatcgccgtgctgcctcctctatatcttcttccaagtacccgtttgaatcaagcgaatgaatcagataattaaaaatctttttttcagtgtttgtcagattcatatcgagtgactgctgttttaacgcatcctgcaatgttttttgcggattacttaattgaaggcccgcttcctgtgcattcatcctgtttttgtttgttttatggtaagatagtggcggtgtgtctgtttcctttcgttcaataagagggttttccagtgagagctcatcaatgtactcggcgagttctgccgaatgatagccaagcagcgtgatggcctgcctgagctcctgtgtcagttgaggctttaatacttgtacttgctgaagtttcatatccatcttgctcactcccctttcttcattgtacatgattgagatcacaccgtatacatttatgaaaaaggagctgccaaagaaatgtctgaacttttttccgtcccttattttattgagaatttaaaacagcatattgaaatgaatcagtctgaggataaaatccacgcgatgaacagctactaccgttccgtcgtctcaacactagtgcaggaccagctgacgaaaaacgcagttgtcctgaaacggattcagcatttagatgaagcatacaacaaagtcaaacgtggagaatcaaaataaaccttccgctcacatgtgagcaggaaggttttccttctttgaggcgtgctggatgagacgggtgcttggcacgccttccatccaggtatgaaagtaattggcgtttttcccgtaggaattatcaatgaccgtgttttctttttgaagaagagaagacaggatgtggccgtgcaacctcgatgtttccaccgattcgtaacggctgaaaaaccgaatcgctttttggacgatataatccgagtatttttcccatatatacgcaatgggcaaagggttgcctgcttttttattcaagacgttcagcgtttggagaaaagcaatcgtccggcggtctgaagctgacagcaccgtgcgccagtcgtagctttccgcttctgcgtgtccctgaagcgcctggtttgcttcatgatctgttcggataaatctcagtttttgattggacggctgctgcgtgggaatgacgggaaacagctgatgaaccatatcaggcagaagctgaatgtgatttcttgaaaaataagcctgtgccgtagcataggaggctttttcccttgtcataatgtgaaggttcgcatgcttagaaaatatctctgccgtccgtttgaggttgtctttgttttgaaaataaatcgattgcggcaggatcacaattttgtggttcggataggtttggacgattttctctctaaagccttgataatacggatacagatccccgaagtttccgcctccctggcagacgatgatgagatgaggatccagctttcgcccgactggaaaattgtcaggattccagcgttttctgacccgaatcccgtgttctttaaagaaggcttctgttcctttcataataaataaatcccctacattcccatatagaggatagtcagcatatataatctctgattgtttcggtatgacgtcgagcagcccggacagtttctgtttcaggctgatcatcgaatgcttgctgtccatttcttcacctcggcagtttggaataagtgcagtagcacttcaatgacccggtcttgctcatcttctgtcatattggaccccgatgggagacagattcctcgcttgaacaaatcttcgcatacgcttcctgtatcttcatgagaataaaataaagccggatcgaatagcggctgggtatggagcggcttccacagcggacgagcttcaatgttttcttcagcaagacgttgaactacgtcatatgggctgagcccgttatcaagtgtgagcgtggtgagccagcgattggatacgcctgctgcgtactccggcataaagcggacgccgtctatgtgaccgagcgcattgttgtatctcgtgaaaatggtccttcttttctccactcgctcatccagcacctcaagctgggcaatgccgacgccggctaagatattgctcagcctgtaattatgaccaatttgactgtgttgataatgaacagccggctctcgtgcctgcgaagcgagaaatcttgctttttcaattgctgcttcatcatttgaaacgagcatccctccccctgatgtggtaatgattttattcccgttaaatgaaaaaatgccgaagcgcccgaaagttccgctttgcttccctttatagactgtgccgagagattcggctgcgtcctcaatgacaggaactccgtatgcatcacacaggcttacgatttcatccattttcgcgctctgcccatacagattgacggcaatcaccgcttttggcagtgttccatttcttttcacttcctccaatgctctttcaagggctgtcggcgacatattccacgtatcaggctcagaatcaataaagacgggcaccgctttttcatatagaatcggattggcggttgctacaaatgtgaaggactggcaaaacacgctgtcaccttcttttacctcaagtaaacgcagcgcgagatgaatcgccgccgttcctgagctgaccgcagctgctgcttttacaccgactcgttctgccagctgttcttcaaatgaattcacgagcggcccaagcggcgcgatccagtttgagcgaaaggcttctgaaatatagtgctgctccctgccgctcatatgagggggagataagtagatttttttatgcatagaatcatcctttgtttgatgtttgaatggaagaaatgatgcgtgccggagcaccggccgccgttaccctgtccggtatgggacggatcaccgcggagccggcgccgacaatgctccaagccccgattgtgatctgcggtatgacggatgcaccggttccgacgtgagccccttcctgaacggaaaccgctcctgacagcgtggcacgcggagacagatggacataatcgctgatctgattgtcgtgctctgccactgcacccgtattgatgatgcaatgagcgccgatgcgcacatccgcctgaatgatcgcgcccgccataatcactgtcccttccccgatgacagccgacttgctgacgatggctgacgggtgaatcaatgtaataaaatcatctttcctcagacccagtcgctccgccagctgttttctgacactgttattcccaacagcaatcagaaacagcacatcaggaatgagcctgcgcagttcagtaacggcttccggcggtcctgtgtaccattcttttccgccttcgaatgttttgaatttatcatccagcaccgcggctaagcgcgtatctgagcgggcgtttatcagctccctgatcacctttccatgaccgccgtcacccacaatggccacgtttttcatgaggacacatctccgcttccggtaaaccgttccgcggtcacatgattggtttgctgaatcccttctgaaacaaggacctttcgcaccgtcaaacataaaattttcaaatcgagaaaaaatgaccggttgtcaacgtaccaaacatctaattcaaatttcttttcccaggaaatcgcgtttctgccattgatttgcgcccagcctgtgatacccggcttcacctcatggcgccgtgcctgtttttctgtataaagaggcagatagtccatcaaaagcggccgcggcccgacaaggctcagatcgcccttcaggacattcaggagctgcggaagctcatcaatgcttagctttctgatcagcctgcccgttttcgtcagccggacttcatcgggcagcagatttccctcactgtcccgttcatccgtcattgtccggaacttgtatagggtgaacggtttgccgtgcaggcctggccttacttgcttaaagaagacaggtgatcctattttcagcctgacaacggcgatggtgaacagaatgatcacactcgtacagcacaacaaaaaaatggcggccgtcagatcaaaaagtcgtttcaggatcaaagattcacagctcctttcgtttttcgaaaccgttttagtaccagctgtctttcctcttttgtacaaacgagcataaaagcgaaaacagcgtagcaaaagctgactgtcactcccgtcgctatcagtgacggccatccgtcaaccttcacaacgaactgaattgccttacagaccgtccaggcaaacacagcggctgatagaggcccgattatgcctttaaagaaaacgtgctttttgtagcctgtaatgcgggatacataaagcggcgtaaagatggcattttttaaaataagagaaatggcccctgccaacgttatgccgtacagaccgagatgagccggcccgctcagcgtgaccgccagcaccacattcaccgcacctaacagcagggtaacaatcgccggtgttttttgttgattaaaagcggtccatatataaaacagcggcataaaggcgaggctgacaaccaagtatccggcatgaataaataaaagcggtgctatcgttgaaaaggacggtccgagccagattgtcaaaaaaggtcccgccaatccgcccaataaggcagcaggaagtgcaagcaaaagaccattgagccttactgccttattggcgtaattcatcaacccttccatatcgccttttgaataatatgaagtcatgataggcgcaaacagggatgcgaccgttccggccaagctgcgcaaaagcagcggaaactggataatcgccgcgtatttcccggatgcggacgcccccagcatcaaattggcggttaacagatcaatctgcaaaaaaagcaggacgccgatttgattgacggagctccatgcgcccgcttgaaacagctccttgcttgtgcggaatgaaagatccttcatacgaaacgaaaaccacggaatcagctttttgaagaaatagaaagacagcacagacgcaatgacagcaccagctaaagctgcaagctggatctgccagattttcggcgcaaagcatgcaaacaggagcagcacagacagcacccgtataagcatttgcaccgcctgaatggaactggtgatataaaggcggttggcataaaatggtgcagcaccgaaacccgccatcagaaacgttaaaataaacagcacactgccgattaaaatcgacaaacgcacatctgccaaaagcgcttgcggcacattcatgacgcggtcaataaaaaaagccgaacccgcaagcggcagcaagagcagcaatgaaatcaaaacagaggccgctaaataattgctgatatacgcatttgctttctcccgctctcccctgtgggcagcaacagaaaagaaccgaacgacaaccgagctgagcgccacggtaataaccgaaaagtaattaatcacattttgtgtcaagtgaacaaagccaaacgcttcgacaccgagcgttttgacaataaaaggcgtcatccaaaccgataggaaaacagacaagagaaaagccgtgagattcgcgctgaaatttatcgtgaatttcatgcctgcttcgcactgcctttcattgtcccccgctgctcgaaaaacagcttgatgagaaaagtgagccgccatttacacagtgctaataccaaacgctctcctcttaataatttctcatgctgaaacggtgtatgtctgacagcctgccgcaccatgtcataggataaaatctgtctgatcttctttttgatgtctttcggcgaattcggagaagcacaggcatttgccaaaagcatcggaagctggtgcctgcaaatgtacacattcaaatcttcttggcatgcgcctgctaagccatagtgattgtagaatgcgattttagcttgatattgtttttgaagatgttcatccatcgccggcttataagggatttctgtcaggctgttcgggttttcacgataaatgtacaatccttcatcaagcattttcacccgctccgcttcgcaaaaagcggacaaattgaagggagagtcttcagcaaaacggatgtcttcagcaaacagcagattcgccctatcaaaaagctcacggcggtaaagataacgccatacataccagataaatctcgtttcgtgagcatgtttaagctgttcagtcatttctcgttttgtcagcacgcggtttgcctcaagctgcggcggcacatatgtccgcctgtccgatgactgtttgtaaaaaccgcatccgacgatgtcgagccgattttcctccgcttcttcagccagcctctggaacatggcggaaaatacataatcgtctccgtctacaaagccgatgtaagtgccccgcgcggcctttattcccgtatttcgcgctgaactaagcccgccgtttgcctgatgaatgacccggattctcgcatcccgttttgcataatcctctgcaattttgcctgaacgatccggtgttccgtcattcacgaggatgatttcaatatcagaaagcgtttgacgaagcaaagaatcaatgcactcccctataaatggttcaacattatacatcgggacaataatgctgacgagcggggtcattgcgcttcaccgctgattttgtcacgcagacctttaaaatacacatctctcggaaagcctgcacgggatgtttcttttgttaaaagctcattgactgcggctgttacgcgctctggctccggatgttctatcagcttcatgaacgggatgtctttaagccattgatagccctccatcaccttatggtcaaaggagcgaatgacaacacacggcgttcctgtcagcgcgcaaaaaatcatgccatgaagcctgtcagtgacgacggcttctgcgctttgcagcttagaccacagtgcttcaagttcttgttcgcgtgtatcgcggctgacccggcggccgatcgttgtcgtaaaggatttgatctcgccgaattcctcacatagcgcagccttgacccggttcctctggtcctcctgaagcacgctttcctgatcctcgcgcaaacacatataaaccccttcgcgttctgcgggggtcttgcttctatctaaatacagcaccatgtccggctgcttcaaaattgttttttcttgaaaatgctgtttcataaattgatacgttgtttcatcccgcgccatcagcaacaggccggggtgcgcattataaattttctgtgcccgtttcagctctttgcgcccttttttcgtgtcagaaaaatgagccgttgccggaagctggacaacccgatagtcatggaatgttttaatgatgaagcggcgcgtccactcctcataacggtataaatcccccatatttccgccgccgatgataaagaccatatcctccggatggcgcgagcggatcaggttttttgctgatttgtaaatgtccttcatatcgacctcgacgatgtcaaagtccgggtattcttgctcaagaaatgccttgctggcataagcaattgcgtgatctcccaaattgtcatgggacggcagcagggtcagtatgatttttttctgatgtgctgcggcctttaccggttgatctgccgctcccagccaatattgggacgggtatttgacctttagcagcagccattctgcaaaattgattttcaacgattgtaacgacatgtcctcaccctctgtttctcattttgtactcgatcacccgctgatacatagccgatgccatagcgacgaacggaatcattctgtatttcgccatcagaagcaggcatgaccgttttgcgtcaaaaggagcggtacccgtttttgaaagactttcttgaaacaccgggtccgcgcatatcacgccaacatttctaagcttttcaaacagtcggcggctgccgctcgttttccattcattcagcatgcagatgctgctgtgaagaacgataaaggtatcaagctccttgcgatactcctccagtttgttgttctcctgtaaaaacgccgcattcgcctcatacagcgcaagtcctgattcaaacaattttttctgatagcgctgcacaatggaggaaaggtgaattcggtaatgatagagcggcgtttttacgtaggatactgagcgggcgaaaaaatgagccctgaagctgaaaaactgatcctcgacatgctccagctcgcctcggagcggaaacgacagccgatgggcttcaatcatgcttcttctgtacagtttgttccatgaaaaccctctgaccttcccttcgaataatgccttgatatagtgctccttcggctgatcctgataggtttgggcaatgtctgagtccatggttttgccagtgtcctcaaactctgcggcgtaattgcaaatgaccagatcagtttcatcgcctgctgcccggagcatctgctcgcaataatcaggttcgatccaatcgtctgaatcgataaacgcgataaattcgccgcgtgccgcttcaatgcctttattccgaaccgcaccgagtccctggttttcctgatgaatcaccttgaacctgttgtccattttggcgtattcttctgcgatatccgggctggcgtcagctgaaccgtcattgacaatgatgatttcaatattgtccactgtctggttccgcagtgattcgagacacgttctgatatatgtttctgtgttataaacagcgactaacagactaaccgcaggtgtttccataatgaccggctcctcgtgcataaattaccgggaaaaaatcgttctgtaaggcagaaccgatgaatcaaccggcataagcaaataactgtaaagaaaataacaaacaacgatagcgatatagataagggcgttcgatttttcatcaaatatcctgacaaaataagggactaagatcatttgatacagaccgaaataaatattgaatctggcaaaaatcacgtcctttgtggccaaaaggccgaacaaaaaaccaagcaggcacaaattgacgacaatatcgatttgcggccacagactccgcaatcgttctttatagcaaaatgcaaggaacagcggcagaaccaaaacagcgattttgatcacattcattccatttgtgttcgtcatgagccatttttcataatggctgtatgagctgttttcaagtacaacgacaaacacagaaataaatttttgatataaaaatgtcatgccgagaaataaagcggataggccgaatatcgccggagaccaggcttttcttctgacaataaagtacaccggaatcataatcagcgccgacgaatgaaagagcgagctgacgagcacaatcaggaaatatcgcttccagttcccgctgatgatataacggatcgcccaaaacaaagcagctgccaccatgtattgcctgatgccgttaaaagacgcgtagtaatgaaaggttcccaaaaacaaaaagacactcagctcaaacggcctgccatagtcggcgagtgtcttcataataaagctgtaggtcacgaccgccaccgtaaaatacatgatttgaggatcttccgtgatgaaattcatcagccaaaggagtgcggtaaaccccggatctgtcgctgttttcgctgtgccgaaaccgaatatctgccacacattttgataatcgcccgccaattcgtacagcagcgtgtacgtctgaaaatccgtgccgactcgatagcggagacctgacacgagcacaagtgaagcgagcggaatccagatcaaaagcttattcggccgataccccgtggcaagcgaatcgtcacggccgccgcacattttagcgaaccaagaccaaataaatacaatccccatattgacggcatatacaatcatcggttatggtccttttccgtgctgatgttgtatacattcagcagcgctcctacattttgctgtgcatcgtagccaagttgagcgagtgtttctttgatgaactcacgcttcggcctgcctgcggcggccgcccttgcaatggtttcagcccagacgctgatcggttcagaaagacttaatcttgtgacaagcccgagaccggcgtcgactttttctgtaatgctgcctgaaatgatgcatggaagccccgacgcctgcgcttccacaagcacaaccggcaagccttcgtacagagacggcatgacaaacacatcaaatgtgcgcatcaattcatggatccgttcttcagtgcctaaaaagagaacatctgatagcagattctgccggcgcgcctcctcctctatctccccgcgcaacggcccgtctcccgccagaacgagctgaaagcgaacgcctctttccttgagatgtgcggcaagcttcagcaggaacgcgtggtttttcacttcatgaaaccgggccacatggccgatgatgagccggtcggctgcaatgccgcgtgctgctttttcttcatcagccgcctgcccatttggggcgaacaactcaaggtcaatcccgttaggaagaaggtgaacacgctcccgctccatattggactgtccaaataaaaacctgcccgcatcctctccgcaggcacacagcgctgtcgcatttgccaaaatgagccgcctgaacacgagcagctgcaagcgatccttccagttgaagccggtcttccaagacgtattgtgggaatggcataccctgaccggcactccggcgagccttgccgcaagggcgataaaacccgtttggaaatccgtgtgcgcatgaacggcgctgaacggcccgttttcttttatcgcttttctcacattcctcacaaatgtaaggggattgctttgcccaatgctcgggacataaaaaagacgcccgcctaaagataaaatctcttcatcataagcgcacggatcatttcgatacgttaaaaaatcaaattgcactttgcttttgtccatcttccgatataaattcattaccatggtttccgcgccgcccctgttcatgccactgagaacatggagtacgcgcttttggctgctattcatgcttgacaagcccttccttttggttcatcactctttttttatggtagcgattcatcacggctgcaggcataaacgcgcggattaacggttttgcgatatatatgtaatcagataaaggaagcttcaagcgtctgcacgcctgatagacaaggatggcattgtcaattgaatacgtaaatgaccgccgtttgaatgcatcgctgtcttccctcactttatacaaggcttcctgaagattatagcccctgaagccctcttcaaaaaagcgaagccacaaatcaatatcttccattcgtctcgtccgccgcaccgaccggtagcctttcagcgtgcggtaggcactcgctctcatcataatcgtgccatggcaaaatggggtcccttttgccatgatgcccggctccggaacagaaggcagaatgcgggcgcctcttacgccaaattcatcaaacacaagcatgccggtgccaaccacctgataatgtcggtgcttttctaaaaacgcgacctgcttttccagacggcgcggaaacgaaaggtcatctccatcctgacgtgcgatataatcgcctgtcgcatgcgaaagacaatgatttaatgatgcggcaagccgcttatttgttttgttttgaatcagtttgatgcggtcgctgtaatgagcggcatactgcttcgcgatgcggagcgtgccgtctgttgacgcatcatcgcacaaaatcagctcccaatttttataggattggctgagtatggattctatgctttctgccaaagtgcgttcgcaattataaatgcccataatgacagaaactttcggtcctgagttcatacgcttttctcctttgtatccatatccatgtacgcggaataaatatctgccatttcttccaccgttcgcgcctccgagaagcgcaaggctgtttttcggccttcctgtcccagctttcggcagagctccggcttatggtaaagctgttcaatccggcgggcaaaagcagcactgtcaccgattttgaccagaaaaccgttttctccgtcgcgaatgatttcccgatgcccgcgattatctgtggcgatcgccggtttttctgccgccattccctcaagcacattcataccgaggccttctctaatgctggatgcgacagatacatccgcaagctgaatcaactcatgtatgtcgctgcaaaagccgtaaaaacagacattggcggaggcaccaagcttttcagctaacgtttgatacgtatgttccattgccccttccccggcaaacacaaggcggagtgagggaattttttcttttagcaaggctgcggcttcaattaactgcttctggtttttgttcagattgagctcagccggataaaccaatataaaatcatcttcacggaacccgtgcttttctctgagtctttgctgctctatcggactgacaggccggaaacgctcggtgttgacgccaatgccgtgaattttctgcgtccttccgcccggcctttgaagtcctttcgcccgtatgtaatcctcttcattaatcgtaatcaggcagtctgtatatgctgaaagccatttctcaaccggatagtaaagaagccaatttttcatcggtgcccctttgcagaagtgaaatccgtgtgctgtgtacagcacctttgttccgtgccgccgtgcctgcctcgccgccagtctggcgagaacgccgccgaccggtgtatggcaatggacaatgtcgtattcataggtgtcaatcactttcttcagctgcctataaacggccaggttctgagggtcaaaaggtgacctgcgaatcgggatggagaatttctcatccacatacggcagcttggtttgtccgttcgcagcgacatgaacctcccagcccatttgtttgaaccatttaaaataagggaggtgaaaggccttaaaatgataatcaacagtcgcgcaaaacaatatctttttcgtcattttcactccccctaatgaacgctggcagccgtcatttcttctgatgtattgattgccgcaaacagcctcgctctcaggtcggcttccggcagctcatgaaaatcctcgataaagcgcatcagcaccggccaatcgccgtccaccgctttaccgatgtgaatttttggaaagatttgttcagcatggacttcatttttgttcagcaattcttcatacattttttcgcccggacgaatgcctgtgaattcgattggaacctgctcagtcgtgtagccggacaaatgaatgaggtttttggcaagatccacaatctttacgggctctcccatatcgagaacgaaaatctgacgccctttcgccagtgccccagcctgaatcacaagccttgatgcctcgggaatcgtcatgaaatagcgggtcattgccggatgtgttactgtcaccggaccgcctttttcaatctgttttttgaaaattggaatgacgctgccgcggctcccgagtacattgccgaagcgaacagcgacaaatttggttctgctgactttcccaagattcataataatcatctctgcgaatcgttttgtcgcccccattacgttggctgggttcaccgctttgtccgatgaaatcagcacgaatgtctctgttcccgacatatcggctgcttccgcgacattttttgttccgataatattgtttttgaccgcctcttctggattgtgttccattaaaggcacatgcttatgggcagctgcatgatagacaacatgcggctcgtattttttcatcaaggtaaacattttatcgcggtcctgcacatcagcgatttccgtatggaacacaatgtgtttgccgaatcgtccgttcagctctgtataaatcgaatgaatgctgttttccccatggccgagcagaatgatttccttaggctgaaacgcgctgatctgacgacagatttccgagccgattgatccgcccgctcccgtgacgagaactgtttttcctttgatgcggttcgaaatttcgctagtgtcgagggttaccggctttctgccgagcaagtcctcagcttttacatctctgatttgtccggcagttcgtgtgccaagcagcatttcatcaaaatgaggcataattttaatgtttactccggttcgcacacattctttatataacacctgaagctcatgggtgcggagtgaaggaatggcaataataatataattaattttgagcttttgcaccgcaggcatgatactttcttttccgccgattacgggcagccccataatttctaatttatgcttcgtttggtcgtcatcaataaaagcgacaggtatgatatcaggttcatctttcgaaagcagctgcctgaccatcagagtcccacctgagcccgccccgataatcagcgcgcgggacgaggcgcagcgttttttcctgatgctttcgtttaatactctggataaaatacgggtccctccaatagacaaaagctgaagcacccagcacgcggttaacagacggaagaacatcgtgtgatacacagcatactgaatgacgccggtcacagcggctgaaagcgtaatgcccttaagcaggacaatcagctcgccaagcccggtgtatgtccacacctgtttatactgattgaacaggaaagcacacacatgatagctgagaagcaagctgacagcagtaagcagtaatgctccggagtcataaaattgataggaatcttttaaaaattgatatcctgcaataactgaatttaaaacgaggtaagtatccagcgcaataatcattgacagtcttctccggtaactcaaccttttcccccctaattcttttatcggtttagctgcggcggttttcgtctctccaaaaaatcggcagcagctaaaccgacaacacgtcctatgtatatatcagataagtgggcatttaacccatcctcacgccccgccagcgacgaccagcatctaaggcagcaacttcagctgcccacagcagagccgagtgcctccattgatacaggtcaggagacatcacctttacaaaaactagtaggaatagtgttccgattttttcattttctttttgtttaaaagagcgcctaacagcttcgcattggattgttccagtgcatcctttgctttcagaacggtatcggtttttgtttttccgcttaaaacgacgagcacgctgccgtctgtctgatttgctagaatctgagcatctgcaacagccaaaagaggaggggaatcaaagatgacgaggctgaattgttcatagatctcagatattaaatctcccattgcttttgaagacaacagttctgccgggtttggcggggtcggcccgcttgtcagtacatataagttatcgatcggcgtcttttgcaccgtctcactgagtgaagcattgccgaccagcacatttgtcagcccggttacattatcaacctgaaacgtctgattgatggtcggctttcttaaatcggcatccaccagcagtactttcttttcctgctgctgcgcaaagacagccgcaagattcgctgcactgaacgatttaccttcaccaggcacagaggaggtgacgaggatagatcgcaagttggtctggacagatgagaactcaatgtttgtccgaatggtgcgatattgttccgcaacaactgatttattgtgtaaaacagatatttgagccaaacctcgccttgctttcttttttctaaagatcactcgcttcactccccgaaatgttttatcccacgattccgccctttgtggacatcaggaacggagcctaagcatggcaatccggttctctcgctgagctgccgtgcgcttttgcaagtatcatcgagaaaatgcagaaaaaatgccagtgtaatgccgcccatgacagcagcgccaaaagccatgaccatatttcgcagcctggccggcttgatcatcgggctttcagaagccttcgcctctgataatatatgtacgccttgtacattcattctttcatctacttctttttcaaacttgttcactaacgtgttcgcaatctcagccgctttcgccgggtcgtgatcctggacggcaacgttgataatttctgattcattttcactgctggtaaccacttttcctttcagcgaggaagccgattcagataggtgcaattccgccttaacttcttccatcaaggcagtgcttttcataatcgattggaacgtgctgctatactgaagatttcgctggatgtcactgagattcgagttttcttcaccgtctgattcatgaaccagcacctgtgtcgacgcctggtaggtcggtgaaatgaccttaaattgcacaaaacccataataagggtgacgccgattgtgatgagcagaatcagcacgaatctgtgtctgacaatcgcatataattctttgaaactcatattctcattcatgtattcatagccttcagccttcccgcggctggcttcccgcgcccctttctgttaatgattggattataaaagaaaacgttattatttaaaaattgcaaaataagccaataagttctctttagagaacaaaatcatgattttcctctaatttactgcacttcccttattattttaaattttataaagaacgaaaaattctttataatgaacaaaataacgacaggaatagaggagaatttcatattatgattggaagaattatccgtttgtaccgtaaaagaaaaggctattctattaatcagctggctgttgagtcaggcgtatccaaatcctatttaagcaagattgaaagaggcgttcacacgaatccgtccgttcaatttttaaaaaaagtttctgccacactggaagttgaattaacagaattatttgacgcagaaacaatgatgtatgaaaaaatcagcggcggtgaagaagaatggcgcgtacatttagtgcaagccgtacaagccgggatggaaaaggaagaattgttcacttttacgaacaggctaaagaaagaacagcctgaaactgcctcttaccgcaaccgcaaactgacggaatccaatatagaagaatggaaagcgctgatggcggaagcaagagaaatcggtctgactgtccatgaagtcaaatcctttttaaaaacaatgggaagatgatgatcggttaagggctaacgttcgcatctatagggtaaatctgtttataatgggggaaaaagggagagaacacaatgactcatcaaatagtaacgactcaatacggcaaagtaaaaggcacaacggaaaacggcgtacataagtggaaaggcatcccctatgccaagccgcctgtcggacaatggcgttttaaagcacctgagccgcctgaagtgtgggaagatgtccttgatgccacagcgtacggccctgtttgcccgcagccgtctgatttgctgtcactttcgtatactgagctgccccgccagtccgaggattgcttgtttgtcaatgtatttgcgcctgacactccaagccaaaacctgcctgtcatggtttggattcacggaggcgctttttatctcggcgcgggcagtgagccattgtatgacggatcaaaacttgcggcgcagggagaggtcattgtcgttacactgaactatcggctggggccgtttggctttttgcacttgtcttcgtttgatgaggcgtattccgataaccttgggcttttagaccaagtcgccgcactgaaatgggtgcgggagaatatttcagcgtttggcggtgatcccgataacgtaacagtatttggagaatccgccggcgggatgagcattgccgcgcttctcgctatgcctgcggcaaaaggcctgttccagaaagcaatcatggaaagcggcgcttctcgaacgatgacgaaagaacaagcggcgagcacctcggcagcctttttacaggtccttgggattaacgagggccaattggataaattgcatacggtttctgcggaagatttgctaaaagcggccgatcagcttcggatcgcagaaaaagaaaatatctttcagctgttcttccagcccgcccttgatccaaaaacgctgcctgctgaaccagaaaaagcgatcgcagaaggggccgcttccggcattccgctattaatcggaacaacccgtgatgaaggatatttatttttcaccccggattcagacgttcattctcaggaaacgcttgatgcagcgctcgagtatttactagggaagccgctggcagagaaagctgccgatttgtatccgcgttctctggaaagccaaattcatatgatgactgatttgttattttggcgccccgctgtcgcctatgcatccgcacattcccattatgcccctgtctggatgtaccggttcgattggcacccggagaagccgccgtacaataaagcgtttcacgcattagagcttccttttgtctttggaaatctggacggattagaacgaatggcaaaagcggaggttacggatgaggtgaaacagctttctcactcgatacaatcagcatggatcacattcgccaaaacaggaaacccaagcaccgaagctgtgaattggccggcgtatcatgaagaaacgagagagacgctgattttagactcagagattacgatcgaaaacgatcccgaatctgaaaaaaggcagaagctattcccttcaaaaggagaataaatatggggaaaacaggatacattggtgctgccattgttgtggcagcttgtatcattattttgtcggccgtggtatgtttacgggacacagtctattaccagcctatgcgctggactggcatcatactgtttttcgtgggaattgtgatggttcccgcatactcagcaaaaagaaaacccggaaaagagaagtaattctcttttccgggtttttatgtttattataatcttcccgcgcgaatatcgtctgtcattccctcataaggagccttcgaaatcacttcttcgttgtcgactccttcatttttcagaaatgtaatttccgcaaattcaggtacaacgtattttggatacgtttcatatttttcgcgggattcttccatcaaatcaatgtggtcattttggtagcaaaccgtaatttcaggatgttcatgcacccatttcgggaagaaaataatgccgtgcatgcgtttttcatttggcataaagtttaatgaaacatccgtgccagtcggctctgtccaagacactttatatacgccttctgtcagtttgacaatattcacttcctgatcccgaacccagcgtccggcaaccattccgctatgaattctataatcaattgtatggtcatttttaatataaatctcgtattcccagccgttttcatacgtataaatcatgtggcttccgataaagttttccatttttcacactctccttagtcttttactgcacttcataaatgtctagtcgaacgtaatcaggggttctttctgcggaaccgataaacaagcggtcatggagccattgatagactttactgcctgtttcaaacgtcggtaccgtacgaaaataaacatgctccggatcaatgatttccccggctgccgcttgttttcgaaacggctcgctgacttgccgtattccattgttttcaatgtaaatcagttcatgatctgctgtttcgatcacatacctggcagataaatcgtttctgccgtcagcgcgaatcatttgcgaatcggcaccgctcggcaaaatacgtccctttacttccccggttattgttcccgaacgaatcggaatgaatcgtctcagtcccaggcctgtctcaccaatcgtgataggcggatcaaccttgatttctaaagaggcgaatggttttaaaaccggcttcttcacgagaaccacctcacctccagaaaaaatcatgtaactatttacatgtttaatttaacactattgcagttaactgtcaaacaataggaacataaaaaaacaaggactgtttgaagacagtccttgtctgaagctagctttgataagcaagatatgtgctgacagtgcttttggcaagacaggcagaggaatctataatcggaatctcactttgaatatgatctaacaccgcatttaaatccgtgcaggctgaaatgatgatgtctgcatgctgactgatttcttcatatagcgtctgccacaatgcttgtgtatgctgcatatgatttggctgtttgattgcggcgataagctggttcacagcctgctgccaatggtccttgtgaacaacttcttgtccatttgccttcagaactttttggtagatggcggattggatggttggctctgttcctaaaaccaccgctttttttgcaggatgcggaatctcttttatcgtttcctcaacgatatgcaacataggaaccgacaatgcctgctgaatctcttcatagtagacatgcgccgtattacaaggcagcgcaatgaaatccactcctgttttctcgagctttaccgctccgtcgataatcgcttttttcatctcgtcatggtcaattggacgatctgcatagaagggcgtcgggcatgaatagatcatcatgtgcgggtagtcaatatcgtttgaagccccatacagcttctgacagtaatcaatcaccttatcaataaacggcgaggtcgatttcggccccattccggctaatattccgatcatcaaattcattcctttctaatttgtacggaccgcttcttcttctgagccatcctcatagaggataaagcttttcgcagcatccccgcctaacataaactcgacttcaacagacaatgctcgcagaaagaaacgggtttccgaggaaggaaataactccagtctcagctgtccggtgatctccaaataaagccgttcattctcggctgtcacctgtgcagccgttccatcctgcaacaggtagctgccaacatagcggctgtatatcgccgtatcaattgcttttttctttttatcagcaggacgttccgggacctcatatggctggccaaatagaatatgttccgccgccttcagaatcgcttgttcatattcagtatcctcttccttattactcaaatagatcagtgttttacgatgatcgatatatcggatcatcaacgtcgaatagccgggccatcctccgctgtggctgacaatccgccctttttcaggactattttgcagtacccagccaaagccataatcaattgtttctccattgttgaggcgcactggagaaaacgcagattccttagaagccttgctgatgaaatcgtcctgatataaagcctgatcaaatcgaaacaaatcgcttgtgacagagttcaccgtcccatctccctgtatgccatcgagatacacaacatagttcgtttcctccagctcatcagggaggacgtatgtttcggaatgtacatcatacacatatccatatgcataatgatcaattcgctcaggcgaaagcctcctgttatacactcttgtttcattcatgccgatcggtgaaaaaatacttgttttcataaaatccgcatagctcatgccagatgctttttcaatgataaccgccagcagcacataccccgtattgctgtacatccagccttcattcggttcaaaataaccagatagcccctcattcatcagcatatcgacaatatcctgattcaccgcaatcttgtgtgaatcccaattggcaaaaaaccatcccatataatcaggaagccctgacgtatggttcaataaatgccgaatcgttacgccctgatacggaaaaccgggcagccagcgatccactttatcctcatagccaagaatccccttctcctccagcaagatgattcccaatgctgtaaaaggctttgacaaagacgctaactcaaacaaagagttggttttcaacgggcgtttttccgtcatttccgcatagccaaaagagtggtgatataaaatatcgccaccctccgcagccagaaccgtcccgttaaactgatgtttttcgcctaatgtctcaaataatgtctgaagatgctttcttttattctgtttcattcctccacctcccatatctctgtacgttactaacctactaacgtttcaaatattttgaaaaacccttcagttagagatcctttttaacccatcacatatacctgcggttcactactatttagtgaaatgagatattatgatattttctgaattatgattaaaaaggcaactttatgcccatgcaacagaagctataaaaaatacagagaatgaaaagaaacagatagattttttagttctttaggcccgtagaccgcaaatccttttatgattttctatcaaacaaaagaggaaaatagaccagttgcaatccaaacgagagtctaatagaatgaggtcgaaaagtaaatcgcgcgggtttgttactgataaagcaggcaagacctaaaatgtgtaaagggcaaagtgtatactttggcgtcaccccttacatattttaggtctttttttattgtgcgtaactaacttgccatcttcaaacaggagggctggaagaagcagaccgctaacacagtacataaaaaaggagacatgaacgatgaacatcaaaaagtttgcaaaacaagcaacagtattaacctttactaccgcactgctggcaggaggcgcaactcaagcgtttgcgaaagaaacgaaccaaaagccatataaggaaacatacggcatttcccatattacacgccatgatatgctgcaaatccctgaacagcaaaaaaatgaaaaatatcaagttcctgaattcgattcgtccacaattaaaaatatctcttctgcaaaaggcctggacgtttgggacagctggccattacaaaacgctgacggcactgtcgcaaactatcatggctaccacatcgtctttgcattagccggagatcctaaaaatgcggatgacacatcgatttacatgttctatcaaaaagtcggcgaaacttctattgacagctggaaaaacgctggccgcgtctttaaagacagcgacaaattcgatgcaaatgattctatcctaaaagaccaaacgcaagaatggtcaggttcagccacatttacatctgacggaaaaatccgtttattctacactgatttctccggtaaacattacggcaaacaaacactgacaactgcacaggttaacgtatcagcatcagacagctctctgaacatcaacggtgtagaggattataaatcaatctttgacggtgacggcaaaacgtatcaaaatgtacagcagttcatcgatgaaggcaactacagctcaggcgacaaccatacgctgagagatcctcactacgtagaagataaaggccacaaatacttagtatttgaagcaaacactggaactgaagatggctaccaaggcgaagaatctttatttaacaaagcatactatggcaaaagcacatcattcttccgtcaagaaagtcaaaagcttctgcaaagtgataaaaagcgcactgctgaattagctaacggcgctctcggtatgattgagctaaacgatgattacacactgaaaaaagtgatgaaaccgctgattgcatctaacacagtaacagatgaaattgaacgcgcgaacgtctttaaaatgaacggcaaatggtatctgttcactgactcccgcgggtcaaaaatgacgattgacggcattacgtctaacgatatttacatgcttggctatgtttctaattctttaactggcccatacaagccgctgaacaaaactggccttgtgttaaaaatggatcttgatcctaacgatgtaacctttacttactcacacttcgctgtacctcaagcgaaaggaaacaatgtcgtgattacaagctatatgacaaacagaggattctacgcagacaaacaatcaacgtttgcgccaagcttcctgctgaacatcaaaggcaagaaaacatctgttgtcaaagacagcatccttgaacaaggacaattaacagttaacaaataaaaacgcaaaagaaaatgccgatatcctattggcattttcttttatttcttatcaacataaaggtgaatcccatatgaactatataaaagcaggcaaatggctaaccgtattcctaacctttttaggaatattgctgtttatcgacttatttccaaaagaagaacatgaccaaaaaacaaaatcaaaacagaagccggactaccgggctgcatatcattttacgacgccggataaatggaaaaatgaccctcaaaaaccgatctattttgatggcaagtatcattatttctatctatataaccgggattacccaaaaggcaacggcacagaatggcgccatgccgtctcagaggatttggtgcactggaccgatgaaggcgtggcgattccgaaatatacaaacccggacggtgacatttggaccggttccgtcgtggttgataaagagaacacagccggctttgggaaaaatgcgcttgtcgcgattgtgacacagccctcagccaaagacaaaaaacaggaacaatatttgtggtacagcacagataagggaaaatcattcaaattctacagtggcaaccccgttatgcctaatccgggtacagacgatttcagagatccgaaagtcatatgggatgaccaggataacaaatgggtcatggtcatggctgaaggatcaaaaatcggcttttatgaatccgataatcttaaggactggcattacacaagcggattcttcccagaacaggcgggaatggtggaatgtcccgacctctacatgatgcgggcaagcgacggaacgaataagtgggttctcggtgccagcgcgaatggcaaaccgtggggcaaaccaaatacgtacgcctactggaccggaagcttcgacggaaaagaattcaaagcggatcagactgaagcccaatggcttgactatggcttcgactggtatggcggtgtgacgttcgaagacagcaaaagcacagatccattagaaaagcggtatgcgcttgcctggatgaacaattgggattatgccaacaacaccccgacaatgaagaacggctttaacggcacagattctgtcatacgcgaactccggctgaaggagcaggatggaacatacagcctcgtctcacagccgattgaagctttggagcagctgactgtttcaactgacgaaatagaggatcaggatgtgaacggatcaaaaacattgtcgataacaggtgatacgtaccagcttgatacggatctttcttggtcagagctaaagaatgcaggcgtcaggctcagagaatcagaagaccaaaaacgccatattgatgtcggtattttcgctgaaggcggctatgcttatgtcaatagagcagccacaaatcagcctgacaaaagcaatacctatgtcgaaagcaaagctccttatgatgtaaacaaacgtaaggtgcatttgaaaatacttgtcgataaaacaacgatagaagtatttgttggcgacgggaaaaccgttttttcaaatgaagtcttcccaaagcctgaagataaaggaattaccctttattctgacggcggcacagcctccttcaaaaatataacagtgaaacactttgattcgattcatgaataaaaacaggggcagcgcaggctgccctgtttttttattaggagcggtattctctgttacatattgggcattgtaagaaatataaggctggtttcaaaggaggaagcgaatgtctaaacaaggaaattttcaaaaatcaatgtcgctgtttgatctgattttgattgggatgggagccatctttggatcagcgtggctgttcgctgtcagtaatgtcgcttcaaaagcagggccctccggcgctttttcctggatcctcggaggagccattattttgttaatcgggctcgtatatgcggagctcggagccgctctgccccgtaccggaggcatcattcgataccccgtttattcacatggccaccttgtcggctacttaatttcgtttgtcacgattgtcgcttatacaagcttgatttcaattgaagtgacagctgtgcgccagtatgtggcctattggtttcccggcctgaccattaaagggtctgattcgccgaccatttccggctggatcttgcagtttgccctattatgcttgtttttcctgctgaattattggagcgtcaaaaccttcgctaaggcgaatttcatcatatcgatttttaaatatattgtgccgattaccatcattattgtgctgatctttcattttcagccggagaatttatccgttcaaggatttgcaccgtttggatttacaggtattcaggctgcaatctcgacaggcggcgtcatgtttgcgtatctcggcctgcacccgattgtatctgtagcaggtgaagtccaaaatccaaaacgcaatatcccgatcgctttaatcatttgcatcatcgtttcaaccatcatttatactgttttgcaggtcacctttattggtgcaatcccgacagaaacactgaaacatggctggcccgcaattggccgggagttctcattgccgtttaaggatattgcggtcatgctcggattaggctggcttgcaacgcttgtcattttagacgccattctgtctcccggaggaaacgggaatatctttatgaatacgacatcccgccttgtttacgcctgggcgcgtaacggcacattatttggcatattctcaaaggtcaataaagatacggggacaccccgcgcatcgctttggctttcgtttgccctgtccattttctggacacttccctttccttcgtggaatgcgctcgtcaatgtctgttcagtcgcgctcattctttcatatgcgattgcacccatttcttcagctgcgctgagggtcaacgcgaaggacttaaacaggccgttttatttaaagggaatgagcattatcgggccgctttcctttatatttacagcgtttatcgtgtactggtcaggatggaaaacagtctcctggctgctcggttcacaactcgtgatgtttttgatctatctctgtttcagcaaatatacgcctaaagaagatgtcagcctcgctcagcagctgaaatcagcctggtggcttatcgggttttatattatgatgctgatcttttcctacatcggttctttcggacatggtttagggattatcagcaatcccgtcgacctcattttagtcgcgatcggctcacttgcgatttattactgggcaaagtataccgggctcccaaaagccgccattgattacgataaataaagaagcaagaggttttcttgcttctttattctttacaaacatacatacacgcgataaaatgaatgagagtcagtcattatcggaggtgttcctcatgccaaaacaaacatcgggcaaatacgaaaaaattctgcaggctgccatagaagtcatttctgaaaaaggcctcgacaaagcttctatttctgatattgtcaaaaaggccggcactgcccaaggaacattctatttgtatttttcatctaaaaatgccctcataccggccattgcagaaaatctcctcacccatacacttgatcaaatcaaaggtaggctgcatggggacgaggatttttggaccgttttagatatattaattgatgagacatttctcattacagaacgccataaggatattattgtcctctgttattccgggcttgcgatcgaccactccatggaaaaatgggagacgatctatcagccttattattcctggcttgaaaaaatcatcaacaaggccattgcaaaccacgaggtaacggaaggaatcaattcaaaatggacggccagaacgattatcaacttggtcgagaatactgcggaacgattctatatcggatttgaacaagatgaaaatgttgaagtgtataaaaaggaaattttcactttcttaaaacggagcttaggtactgcttaaaaaatgactgggtaacaccgctcattttttaatgccctaaaaatgactgacgttcattcataaaatagagaggtgtttcatttgaattgggttcttgtttttattgcagggcttttagaagttgtttgggcctcttccctcaaacatgccgattcgcttttggattggatcatcatttttatcttaatcgcggtcagctttatcctgttgatccgctcttatcaaaaaatcccgatggccgcggcgtacactgtgtttgtgggaatcggaaccgtcggaacatatctgactggaattgttctgggcgaatccttctcagcagcccaaatgttctttttagctttattgctggctggcattttaggaatgaaattatttacgaaagaaagcaaatctcagccgggaggtgaacaataatggcatggtttttattagtgattgccggcatagaagaaattatagctgccattgccatgaaatatatagacggaacaagaaaaaaatggccaatcattgtgatgactgttggattcggcttatccttttactgcctttcccaagcgatgatcgtcctgcctgccggagtcgcatatgccgtctggactggcattggaagcattggtgtttcggcggtcgggctcatctggtttaaggagcggtttcagctttcacaggtgatttcactttgccttatcctagccggcgtcatcggcctgcgtcttacgtcatcttcataaaatcaaggcatatacagctgtatatgcctttgccattaagcttcgtgatgtttttgaagatgaagcggcggtgggatgagccagcctttgttttttagcagccttaagtattttgcgccggttgccgctttcgacatatgaaattgcccaaacatcatggcaatatcctcacgaatcgattgccccatcattttgctgcatgtcaccagacctgcagcattttctgctgccgcggaggccgccacatccggatcgagaaaccgtgcgccaggcggaatgtcgttaagatctgctgtcggcggttcaggagaagccggcggcagcgccaccccgttttctttcaggatcgtgctgacctgtttgatttcatcttggcatttctcaatagactcacgaagcagtttcttcaggtcgtcatcaccgacatgattcaatagcatttggtaattgccgaccattttattgcccgccatcacataactccacaagccgaatacctcaccgtaatgcatcggttcatcctgcggatttccgcttaaaatacccatgttcatcctcctcccatattcaatattgcacatttcataacgtgcccaagcggaggaacatttatgtttcagcggaaaagatttatgaaatgaaacaaaacaaaaaagacaagagtggcaagttgccaaaccattgtctttcctgttgtttgattggacgcactgaagggattcgcaccccgacagacaagataccggaaaccattcaagtgctttttaatatgagtcattgattctgtctttaataaactttaacgagatggcgggatgctttgcggaaaacgaaatacattttcggggtcatatttcgcctttatttctcgaagccgcgcaaagtttgcgccataatattcttttccgaagttttcaatgttttgatctggaacattaacatatgaacctgctacatatggttgcatcagctgacgcactctttcaactgatgcaagatttgaatcttcttgtgatttatttttccaactagccgtccattccgtataaaatattggatggcgccaaaaaaaggcagtttcgtctttagggactctgcttatagcaccaccccaattgataaaaaagaaattggcatctgttccagtagcgtcttccaaaaattttctcatgattgaaatgggttcgtcagaccaaaaatcatgaccccaagccgaggagaatttaacactctgatcatttctgccagggatgggttcgtcagggtctaagaaatctatagcatctggatagtataatgttttgatatctgcttctgttggagttcccgcatgtaataaaggttttaataatcgaatcaattcagttttcgaaccgaggaaaattccttctgcatgacacaaaccatttattttgctgtaaatttcaaggtagcatcctaatcgttcatctacaaacggagcccatttctgccaagctttaaataccgtttctaattgttcccacggccagataatattgaagacggttgcagttttaggggcacgatgaactttgaatgtatattgggtattatatccaaagttacctcctcctccgcctctagaagcccatagcaaatcctcattgtgagattgatctgcatgaataatccttccttttgcatctaccgttttcagcgcgagaaggttatcacttataaggccaatcgatcgtgagagtacaccaaatccgccgcccatcgtaattcccccgattccaactgttgggctatctccaaacggagccataaaaccgtctcgagctaatccctttacaagcgggccaacgggaataccagtttgaacggttgcaatcgcgttttcttcatctaagaaaactttattcatgtcactcacatcaataacaattcctccacttactactgaaaggttcttatctaaagcatggcgaccgcttctgacacgtaagggcactttattctcacgagcccatttaatggcattacttacatcgtatgaattttgcgcaaaaacaaagacaagaggatagacatccacataagggttccaattcttaatagcctctgtatagccggggtctcctttgaaaattacacgccctgtcaactgtgttgatcccatatattatttcactcctaaagaaattcgattcagatactaaaatatgcaggagctggataatcgcatagacaaatgatctacgaactataaatataatacgctaaggcctttttcgtcggtaaggtctgctgagaaacatttttcaaacaattttgagcaaacttcctgtccaatcctccaacaagcgttttttcttatcgtttttaggagcagtgtccagtttttttcggagtgaatattcgtttaggccaaaagaaaagagagatgaagaagtgtttagtaccagaggtatacatccatacaacagactctagatcatcatatactgaatgtatgtagaaaggagacatcagctttggcaaaatatcggattatgacctttgacggcggcggtaccttaggtgctttaagtttgcaactgttaaacagattggctaggcaaaacccgaagttaattagtcgaacccatgtattttcgggaaattcaatcggttcatttactgcccttgcattagcaagcggaagatctccgagggaaacacttcagtattttgaggatgaaatcctacccgcattcagcatttcccggccaggcggacctgttttcaaccaacaattaccctattccggttttattaaagcggtaagaaattttttcccagcagatcttcaacttatagatttaagaaaacgaattgttgtcccatcattcaaattatactctcaaaaactggatcgttggactcctgtcttatttcacaattttcccggctctccctatttaaatgagaaagtaagtgatgtcatactgcggagcagcggtgctcccgcgacgcaacgggcctatcaaaactatgtggatgggtatgtagtagcaacgaaccctagtacagccagtatcgcgtttgcagttggtaaagccaatgtgccattggatcaaattgcggtattgtccatcggaacaggtgaagccccgacccggttaagaagagatacgaagggatggggaatggtaagtgcagataacatccgccccgaaaatctgaagaaccttcctccaaattggggagttcttttggacaggtcgcctaatgaacctttactgccatttcttcagatgattgctggcggtaatgggtactatgaatccatggtcagtgcgaatcttctgggagatcgttttttccggttagatccacggattccgaacttctccaaaacggaccctgccgtcgttcccgctgtcattgaaattgcgaacaaaaccaacttacagcctgcgattcaatttatagagaagaactgggggagtaaataaatttttattttaaaactattctcacttatccaattttgtccgagagaagattctcaaaataaatacaggcaatgggtagaaccggatttttttaaaggtttgttaatcacaagctaataagatgaatgaaaaaatcaattcatacttcttcttttgaaagtgagggttcaaactaaagaatgtaattgaaatgttactctaaggtatgcaattccctttttcacacaaaaaagacaagagcggcaaatcgccaaacccttgtctttcctgttgttctattggacgcgctcggagggattcgaacccccgacagacgtggtaccggaaaccaccgctctatccaactgagctacgagcgcagaatgactgcgttatgagaacgtcagcacaactaattatacgataattccattcaaataacaaccctctatttcgagaggccgttttttaaatagacaaagcatcttaattggcaatctgacatacgatggtttgaacccctgtatttttggggaaaatgggaaaaagagacgactttgcatatcaggccagctttttgtttgacctttattgaccaaaaatgtatcatgtaactacatacttacctaaaaggtgaaggaggagcattatgaatttaatacctacagtcattgaacaaacgaaccgcggggaaagagcgtatgacatttattctcgtctattaaaggatcgtatcatcatgcttggatctgcgattgatgacaacgttgcgaactccatcgtgtcacagcttttattcttagcagcagaagaccctgaaaaagaaatttctctttacatcaacagcccgggcggctctattacagccggtatggcgatctatgataccatgcagtttattaagccgaaggtatctacaatttgtatcggtatggctgcgtcaatgggcgcgttcctgcttgcagccggcgaaaaaggcaaacgctatgcgcttccaaacagtgaagtcatgattcaccagcctcttggcggtgcgcaaggtcaggcgacagaaattgaaattgccgcgaaacgcattctcttgcttcgcgacaaattaaacaaagtccttgctgaacgtactggccagccgcttgaagtgatcgaacgcgacacagaccgtgataacttcaagtctgctgaagaagcgcttgaatacggcctgattgacaaaattttgactcacacagaagacaaaaagtaataacacaacctgcaagagctgcgtctcttgcaggtttttttcatttcaaggaattgactcccttaaacactttttgttctatactgctcccatccctcatgtaacagctcaagcgtcaaatcattcgtctgcctcacaaccagatcagcaccaagcatcggctgtccttgaccgacaccaaccgcaaacatccccgcagatttgattgcagaaatgcctgcttctgcgtcttctattgccgcgcaatcagcaggggaaacatcgagcatcgctgcagctgttaaaaagatgtcaggatcaggcttccccttcgcaagagtcgtcggatcaacaatggcatcaaaatcatcgataattgccaaacgtcttaaaatcttaggagcattgcgacttgaagatgctaacccgatttttatattttcgtttttcaattgacatagaagcctgccaatccccggtaaaagatcttccggcgtcaatttgctgatcagcatttgataatcgcgatttttccgatgcataagctcttgtttctccgcatttgtatactttgtttccgcaccgccaaagatcaatatgctttcaagtgactcttctctgctgattccttttagcctttcattcatgtctctgtcaaaagggatattaatttgttctgcgatgtgcttccaagcgagaaaatgatattcagcagtatctgttatcactccgtctaaatcaaaaatgaccgctttcatatactaatgcccatcacagcttcataaggtttgaggctaatactctttaagtccgcccgctcctgcggatagtttgaaatcagcactttccaacgctcatgaatcagttctggaggcgcttcgaacagagccttttcttccgataaattcacaacgacaagaagcttttccccttgatattctcgaaggtaagaaaagacctgcggatcattctcctgcaaaagctgataatcgccatatatcataatcttatattgctttcgtaattgaatgagcttctgatagtaaaagaaaatcgaatcttgatctttcaaggactctttcacattgatatcttggtagcgggaatttaccggtatccacgggtttccggttgtgaatcccgcatgttttccggcatcccactgcataggtgttctcgcatgatcccttccttttatcatcacggctttgagaaactctttttctgacatcgttttgttttcgacgactagttcacgatatgcattctttatttcaagatcatcatacatctccagcggcatatcgctgttgaccatgccgatttcttctccctggtaaataaacggcgttcctttcatgccgtgcagaaccgttgcaaatgccttcgcacattctttacgcagcttcccatcattgccccagcgggaaataaccctcggctggtcatggttctcaaaatacagggtattccagccgacattcattaacccggtctgccaccttgtcatcgtcttttttaaagcaatcaaatcaaacggcttgatctgccatttcccatttggcgagttttgttctgtatcaatatccatatgttcaaatgtaaagatcatattcagctcttgcctgcttgcatctgtgtactttttcgcctcttcaatatcagagccgtttgcctctccgactgtcatgcagtcgtaatgagaaagcacttccctgttcatctcttgaataaactcatgaagacgggggccgttagagtgataacggccgacaatatagctgcggctgtgatccgtttcgtagtccggaaaatcggtgtatttagaaatagagccgatcacatccatccgccagccgtcaacgcctctatccatccagaatctcattacatcataaacttcccggcgaacggcttcgttttcccaatttaaatcaggctgttttttcgaaaagtagtgcaaataatactgctctgttccttcatcgtatgtccacgctgagcctgaaaagatcgatccccaattattcggctctgagccgtccggtttaggatctttccaaaaataataatcccggtaaggattgtccttcgacttgcggctttcagcaaaccaagcatgctcatctgatgtgtggttcacgaccaaatccatgacgattttcattccgcgtttatgggcttcatcaatcagctgaaacatatcttcatttgtcccaaacttttcgtacatgtttttgtaatcgctgatatcatatccgttgtcatcctgcggggaatcaaataccggggagagccagatgacatccgccccgagatttttgatgtaatccagcttttgaatcacaccttgcaaatccccgaatccatctccattggcatcataaaaactgcgcgggtaaatttgataaacgacagcttctttccaccattcactcattaggcgttctcctttcacatcgtccctgtaggacaactggttcctcataaacgttcatgtgcagcggctcgccttttacaagctcaaaaataacgcgcttttcgtcaaccgtcacattgattaatcgatttcgataattgatgttgaatgaatattcgtcccattctttcggcaaaaacggagcaaatgacagcgtctcattcgcggtgcgcatgcctgcaaagccatgaacgattgccagccagctacccgtcattgaagtaatatgcaagccttcttccgtatcatgattgtaattatcaagatcaagccttgctgtgcgcttatataattcgagcgctttcttttccagcttgagttcggctgcgagaatcgcatggacagagggcgataggcttgattcatgaacagtcatcggctcataaaattcaaagtttcgccgtttttcttccattgtaaaacggtcattaaaaagataaatgccttggagaacatctgcctgcttaataaaattggagcggagaatcttgtcccatgaccaattctggtaaagaggccgttccgctggatctaattcgtcaactgcttgcaggtctttatccaagaacgtgtcatgctgaacgaaaatttgcagttcttcactatacggatagtacatgtgctggatgatttctctccagactttcaattcttcttcctgtacatccagaaggcggcgtttctccgctgagatactttcgagactttgtagagtatactccaacgtccaagccgcaatgacattcgtataccaattgttgttaacgttgttttcgtattcattcggccctgtgacgccatggatcatatacttattttttcgtttcgagaagtgaacacggtcggcccaaaatctgctgactgccacaagtacgtctatcccgtattcttccatatagttacggtcgcctgtataattgatataattgtagatcgcataacagatcgcgccattgcggtgaatttcttcaaaggtgatttcccattcgttgtggcattcatcaccggtgaacgtcaccatcggataaagtgcccccttcatccccaattttgccgcgtttcgttcggcagcctccaactgatgatagcgatacaaaagcaggtttttcgtcacctccggctcggctgtcgccaaatacatcggaacggcgtacgcctcagtatcccaatatgcggcacctccatatttctcgccagtaaatcctttcggcccgatattcaaacgggcatcgcccccgtaatatgtcgagaataactgaaagatattgtagcggattccttgttgaagctcctcatctcctttaatctcaatgtccgcttttgcccatctttccttccatcgatcagtgtgcctccgttttgcatcttcatagccgttctctaccacatccgccaaaagctccttggctttcgataaaagctcttcctcccgaaaatcacgggaagtcgtgacaatcacaaactttttcaatgatgccttcgtttggtagctgtagcgattctcgacatacatttcattcgttttaaagcttttattgacaaaaccctccgtctcatttgccattgcggctaaaaccgtgaagcgcggtgttccaaatggattttcgatcgtttttgccgctaaatggccgctgtgagaatcagcacctttcgcttcctcctgccaaaactgttcttggtagttagaatcttcatttgccacatttccatccaggtaaggaacaagcgtaatgacagcatctcccgtcaggcactccgcttcataatgaatcgcacagagttcttttacagcaaggctaagaaaccgctctgacctgattctgacggatttatcctgaatgcggacaacagcgcttcgccgcagaatcccctctttcatattgagttctacctcaaatgattcgattgggttttgatggagatcgattttttcaccgtcaacatataggcctatgcccataaagttcatcgcattgatcacttttccgaaatattctggatacccgtttttccaccagcctactcgcgttttgtcggggaaccacacgcctgcaatatatgtgccttggtgactgtcgcctgaatagccttcttcaaaattccctctgacccccatatagccattggcaagagacgtcaggctttccagcagccgtgtatgctccttattaaatgtatttgttttgattttccattcatcaatctcaaataaccgctgatttatcatcatttcctcccgaatgtaagtttccattatcacggcgggttttggtcaaatatctaaatgcaaaagaaatcatcaaagtaacgccacacgaatggatcatcaatacagtaatcaaatcaaaatgaaccatgccgatagcagctgccgcaaatgccggcagtgccgaggcgcaaatcgccgtagatactgcttccttgaatgacgcaatagagatcatgtttgatatttttgtgatccagaggccacctgcaagaacaaacgttaacaaaagctggatcataaagattaccgcatatgccagcatcatgatcatcggcttatactgtgccaaccataatgtatcgatcaaaacctctacatcatggacgtttggtttctcgagcttaacgtccattttcgcatagccaacagaaaaccccgtttcgttttgatcggtgatcaccagttgatcaggttgaaatatgatagcgttttcaaatccagttactttcaatcgcccattttcaccgcttgtctcatattcatgcttcatatcgactgccatcacattctgcccatcttcaatcctctcagaactcttcccgcctgttagttttccgttcctgatttgaaaaccctgtaattgatcagcaaattgatcattaaccccttgaatcgctgacggcatgaaagatgcaacgctgaagcgatccattttcacaaacgaaaccgctaacggcgtcattaagcaggccgttaaaaacagaaagagaaaagagagctgcagccagctgaaagtattcccgtaacggcaaacacctgatggggatgcacccgccttcaggcagcggatgataaagcttttattctccagattcttcattggcattacccctttgttccgccggctgtcaatccggacacaaagttcttttggagaaaaaagaataagacgcatatcggcagcgcggcaagtatggcaccggctgcaaatagagctactttttgctgctgcggattagaaataaaggattgtaatcctacagcgatggtcagcctttccggtgagcgaagcagaaatttcgccagcaaatagtcgccaaacggtgccataaacgcccaaagcgcttgtaccgcgagcattggcttaacaagcggcagaacaattgaagcgaaaatcctcagatgtcccgctccgtcaattcgcgcggcttcatcaatttctctcggcacagtatcaaaataacctttcatcagccacgtgttcatcggaattccgccgccgatatagatcgctgttaaaaaccagtattgatcgagtgcgcctattagcatcgccaagacataaaaagcagtcagcgccgccattgtcggcaccatttgaatgattaaaaagaatatcaggctcttttttctgcctgcaaaccgatagcggctgtacgagtacccggcaagtgtcacaatcgtaacctgcaaaaccatgaccgatagcgcgatgacaagtgtattgctgtaccaatgaagataaagcgtttcttcaaatagccgcttaaaatgatccaacgtccaaggacccgaaaaatcgagctgaaaagccgccgaattccccacacggaaggctgatgatgccgtaatcagcaacggatatataatgacaatacttaaaagcgtcaaaaagaaatacgtacagattttattaagcattctggcagtgctcgcgttcacctacataacctcctcattgccaaaagcattcgattttttgaaagcaatcagtgaaattccaatgacaatgaaagaaattaacagtgtcacagccgccgcaacggaatattggggtgatgtgcctgttgtcagtttataaatccacgaaattaagatatcggtcgatccggccccggctcccacactgcctggccctccctcattaaataaatagatgatcgagaaattattgaaattaaacgtatactgagtaatcatcacgggtgctgtggcaaataaaatcatcgggaatgtaatatgccgaaaacgctgaataaaagtggccccgtcaatctttgccgcttcatacaattcacctggaatcgcctgaagcactcccgttaccatgacataaatatatggaaagccgagccacgtctgaatcataatgagggctgtctttgtccagaaaggatcagtcttccacgcgatcgcaggcagctcaacaaacggcaggtgattgaatagtggaatcacctgtgcattcaccgctcctatgctgtcgttaaacatgttggaaaaactcatgattgtaataaacgccggaacagcccatggaaataagaaaatcattcgaaatatccgcttgccttttataaaatcctgattgacgaaaagggccgtcacaatacctaaaatgatttgcagcgttgttgcacagattgtccagataaccgtccagcccagtacattcacaaatgtttcacgataggagccaaggaaaaaaatattcaagaaatttttaaacccgacccagtcaatcagacgattaggcggaatatgataaaaatcatagtttgtacatgcaacaaacagagtcaccaaaaccggaaagataatcacaaacaccatcatgatatatgccggcagtgtaaatagatatggaaaccctttatcgcccgcatgacagatcatatccttggctattgtattgacttccaaacccgccgctttcatagcggcggtcttacgtgaatcatgaatattaaagatatagaacatgaggaaaatcattgtcacgatcaattgcagcgtgccttcaatcagcataaacagcgagtggtcttcaccgggaacacttcccaatgtcatcaatccggttagcgcctgtataccgaaaacgcataattcaaaagcaaacaagcctgtaatggcaagaaataagagcccctttgacaattgctgattcgcaatctgcccaagtcctggaatgatcgataaaagccctgcctttcgtttttgctttgcaagtgtgtgatgtttattcattttttccgccctctattcttccggacgctatcccgccgttttatttcacatacttttctttaatattttcctttatgacgtttacagcatcattcgctgatgtttgtgtcgatttttttcctgaagctgcatcaaaaattaaactttccgctcctgtccatacttcagccatttccggaatatttggagtcggcgtcgctgtttcatattgtttaatcacagctgacgtcagttcattcttttgctcatcggctttcctccttgcggcagtgttggccggaacttcgtttgtattctgataaaaagcgtaagcattggcatcatttgcagcatactcaagccatttttcagccagctcgggctcttttgtatattttgaagctacccagcccttcccgcccgcaaaaggggcatattcttctccattgggcaatgtcggaatgggagccgctccgtagttcaatttagcctctttatagttggcagctgaccaaggaccgccaatgatcgcagccgctttgccttctaaaaacatctgctgaataaagtcgtctgcgcttgaattgtcttgcattcctttcggccaatatgtttcaaaccatttctccgcatatttcaccgcttctacagcccctttattgttcaggccgatgtccccggaatctgtgccgttttttccaaacacatatccgccgtaaccagccaataagccgtacgacatataaaagtcagtccattttgctaaaaatccggttgattttcctttttccgaagcaaacgcgaatcgaggatcttccgttaacttttcaaggtctttaaatgtttttggcgctgtttttaaaagatctttgttgtaatacaaaataagtgtctcaatgactagcggcattccgtacactttgccgtcaactgtcacctgctgcatttctttatcaccaaagctttttgtgttagatggcttaatatcaagtaaatgtccttgttgtcccaaaccgccgatccggtcatatgcagcaagcataacatcaggcgcattacccgccgggccatcaagaggaagcgcttctaactgttcgaacatttgcttttcaacaatttttactgtgacatcattctctttttcgaactttgtttttatgctttcaatgtattctttatacgtttcttcgacggacacagtcagcacctttttgccatcagcgcttgctggattttttgaacttgagcaggcggcaaggccgattgccaggaatgatgccgccaatatggcgaaccccttttttaaaagaaccatctcttttcccccttctatttacgaaactataacaattgtattgtcctatagaaagcggttacaacaacttttgatttgttaccgataacagaatgttatacaggggcggcagcactcaaaatcaaaaattctcccggctgaacggtaatgacatcgtgatgctgaagcggctgctctgtccatgcatcacagatcctcttattcctttcaatattcaaatccagtaaactgacatgttgaaccgcattcccttgattaaagaaataaatcagtattttttcatcaagagtccgtgaaaagctaataaaatcgttttggtcatccagcagattccactcaagatgtccttcagtcaataaagtgttttcctgcttgcgtaaagcaattaaccgtttcataaattgcagcatgtcttggttttgcttctctttttcccaaaccatacattttcggcataatggatcattttcgccgttcagcccgatttccgttccgtaataaatgcatggtgagcctgtctgggcaaacataaaggccagcaacgcgcgtgctttcttctcatcattgcggcatctggtcaaaaggcgctttgtatcatggctatccagtaaattaaacatcacctcattggcctgcttcattccattcatcaaatgtgcattgacacggtgagccatacgtgaagctgagatcgtctggtcagcaaagtattcaatcataggctctgtaaaagggtaattcatcgccgcatgaaattcatcccctctaagccagggttcggcagaatgccagatctcacctaaaatataaacatcaggcttttcagtagatacagcctgcctaaatgtcttccaaaaagcgtgatccacttcatttgcgacatccaaacgccagccgtcaatgtcaaattcgcgaatccagtacaaagcaatatcaagcaaatatttctgcacctcgggattagccgtgtttagcttcggcatatcagctgtaaaagcaaacctgtcataattgtcgtctgtgacgggaaaagagtgaatatggaaccagtctttatagcgggattgatctccgtttttgacgacatcctgccattgcggagacgcgcttcctatatggttaaaaaccgcatcaagcataattctcatcccccgctgatgcagctggctgaccaatgtacgaaaaagctcaggatccccgaaatgcggatcaatagaaaagtaatccagcgtgtcgtatttatgattagaaggcgcggaaaagatcggtgtcagataaatgccgttcacccctaaatcctctaaataatcaagcttgtcaacaattccttgtaaatcccctccaaaaaaatcattgacgcccgggtccttgctcccccacggcaatgcattcttcggtgacaagtcttctcttccatttgcaaaacgctccggaaaaatttgataccaaaccgttgacttgacccattcaggcgcttgaaatgtatcagcctcgtgaacaaacggaaatttaaagtaataatgaatcgtttccagtgttttttcgttataagggcatacacccgaacttccgaaaaagatgtcttcatgatcgtctgttacaacaaacgcatattgtaaacgcctaaatggcggcaccacttcagcaaaccaatagtcatgcatttctgtagcagcaattttcctcatcggctgctcgtttgccgaccacttgccgtcgttgtactcatagggatcaccccaaatgaatcgaatgtgatctgcatcacctttttttgtccgaatcttgatatgcacagcccgcccatcataagaataagcatctgtgctgaatggctggtggtgaatcgctgcatattccatcatgtttccccctttgatttccgttttattgaagccggctcatagtttgaaagtatcatgatgaaattgtgggaacaatccttttcaccctgttaccgataacagaataaggcgcttacagcgttgattctcgtacaattaactctggttcaaaaaatagacttccttgtgcagcaccgtcttcattcatttttttcagcaacattttcgcacaggcttcccccatttcaacaacaggctgtctgaccgtagtcaagcgcggcgaggagatgcgatcaagaaacacaccgtcattcccggtaaccgcaacgtcttccggaattctctttccaagggattgcgccgcacgaatgacgccgagcgcgattcgatcagatgcgcagacaaatgcggcttgattgtccatggatttcagcagttctcttgcaaggccctcacttttcttagaactgttgtcgatccgaaacatattcgattttttaaagcttttattcatcgcccgtatatacccctgttctcttgcacgttcgaaaggctcatctaaatcaatgccaaaaaagacaacttcccgctcccccagccccataacatggcgggttgccataaaagtgcctttctcgttattcacatcgataaagtcatagcccatttcattttgtccaaatacgacgagcggcttctcaaacgcttttattacaccttcaaaatcgttctttctcaagccggtggcaataatgccgtcacattggccaatattaagagaatttcttgtcacaagctggagagcatagtgattgcgatccagctccctgctgattcctgtcagcaggttcatgtaatatggttctgtcgtatccatttcctcaagtatcaatagtttcacaacctgtgttctgttttgcacgagcgctctcgccgcataattagggatgtaattcagctctttcatcgcagaatgaacaagctttttcaattcatctgtcaccgtctcagggtgattgatcactcgtgataccgtcattttcgaaacatttgctttttttgccacatctgacaatgttgccattttcatcccctccttatctgtgcttattatccaaactagtgataaagtcctctattactgttaaatatacgatgcaggcaaaagagaaataaaaaagagatttcccttaaggaaacctcactttgttaaaaactctcgatttttcatggattcatacgctaggtggcagactcattctctccacttccatgagaaagtctcttttttaaatttctgtccactttttttctaaaatcggataagaataattttgcatttgctcaattaactcatccggccgtgacgagctgtgaatcagttttaggtgcgattcgttagaaaacccttcttgaatgctgtatttcaccattttcatcattggttcaaaatatccgtttacattgtacagtccgattggcttttggtggatgccgatctgtgcccagcacagcacttcaaataattcttcatatgtaccaaagccgcccggcatcgagataaagccgtccgccagctcgctcattttagcctttcgttcatgcatcccgtttacttcaatcagctcagtcagattctgatggacaacctccccgctgaacaaaccgctcggcatgaccccgattgcagttccgccgttttccataatcgcgtcggcaatcgtgcccatcaagccgacgcgggagcccccatagacaaggccgattccctgctcagccatatacacgccaagctctgccgcttttcttttatacgcttcatttcccccagggtttgatcccgcaaatacacaaatggttttcatcttgtcatctccgcatctatatatcgtgttaaacattcaaaaacacactatatattgtcccatcttcatgtgataatatcaatatgaaatacataaagaatgcaggagtgatgaggttgcagctggctgatgcagaaaaatggatgaaagagttttacgaaaaaagaggctggacagaatacggaccttttattcgcgtcggctttttaatggaggaagccggagaattggcccgggctgtcagggcgtatgaaatcggcagagaccggccggatgagaaagaatcgtcacgcgctgagcaaaaacaagaattgattgaagaaatgggagatgtcatcggaaatatcgccattcttgctgatatgtatggtgtctctttagaagacgtcatgaaggcccaccaagaaaaactgacaaaacgatttgagcatgcataaaaaagcggccgcgatggccgctttttttaacctgtgatttcatcatggtgatcaaagaaatgctgctttcctattttgtgaaaaaggcctgttttatgcagcagctcctttggctgcgattgcaatcctacaatcatcagctttccattgtggcgtttaatccgattcataatgttcccaagcaccgcttcagctgacgtatccatatagtgcaccttattcatgagcagaatgagggttttcggttttttctgtacatgctccagcaatgacgattcaagggaatcaattgatccgaaaaacaacggtccttctatggcatacatgctgacagatggatcttctctcttcgccagaacaggatgcgattcctgattgtggatgcgggtcgcttcgctcattcttctgataaagaacacaaatgcaagcagcaatccggttgccacaccgatgattaagtcaaacagaaccgtaagggcgaaggtcgccgccaaaataaaggaatcagcgtttttcagtctcagcatgtttgcgacttccttgcgctcactcatattccatgcgaccaccatgagaatcggtgccatactggcgagcggcacatgggacgcataaggcgcaaatacaagcaggacaaggagaacgactacgccgtgaacgacgccggaaactggggaaaccgctccgttttttatattggtcgccgttctcgcaatcgctcctgtagccgggattccgccaaacaggggcgctgccatattcgcaattccctggccgacaagctccttattgctgtcatgctttgagcccttcatgttatcagcgaccattgcggacaaaatcgactcaagtcctccaagaagcgcgatgacaagcgcagccggaaacagcataaccattttatccaaagtaagctcaggaaactgaaattcaggcaaatggcgggggatttctccataagttgacccaatcgttgccatgcggtcagggaaaaagacaaccgcgaccactgtggaaataagaagcgccaacaaagcgcccggcactttaggcatcaccttggcggatacaagcaaaatgacgagcccgatcacagctgtcaaaatggcatatacgttaaaggtgccgagctgctgtacaatttcaaacatgttgtggtgaaagttctcatgtttttcaacatttctcaatccgagaaaattagcgatttgttccgtaaagatcagcacggcaattccggctgtaaaaccgacgataacgggtttaggcacgaatttcattatttttccgagcttaaacagcccaaacagcaccagcattacccctgccataaaccctgcgatcagcagattctctaatccgtactgcatgataatgccgaacagtatcgggacaaaggcgcctgtcggaccgccaatttgatatttagatcccccgaacaaagagatacaaatccccgctataacaacagtgtacagcccgtattcgggctcgactcccgaggcaatggcaaacgccattcctaaaggaattgccacgacacctactacgatacctgcaattaagtctttctgaaatttctgtaaattgtatcccttgaatctccctgagaatcgcatattttgttataacctcccttatgagtgattgtttattagctcagtttcataaccgttaatgaccacatcaagttttcctgtttcagggtgaatgacaagcccgtgaaccggcacttttttcggaagcagcggatggttcttaatcatgttcacactgtgggaaacgctttcttccacgctgtgaaaaccagtcagccacgttttcaaatcgagtccggcactcgtcagcaaattcaggcagctatcctccaccccgcgttcctttgctttctcaagaatcgaggacgcattcagccctgacattccgcattcatgatggccgacaatgcatacctcttcagcctgcaattcataaatcgcgaccagtatgcttcgcatcacgcttccaaatgggtgagaaacgatggctcccgcgttttttacaattttagcatcaccgtttttaagccccattgcttgcggaagaagttctgtaagccttgtatccatacaggtgacaatgacgagctttttcgaaggaaactttgtcgttttgtacggttcatacttcttctcactgacaaaccgctgattgtgttccaaaattgatgttaaagaaaccatttgattcatctcccatccatatgattttgcaagccttcttacccagcttacagtaaggaattatagcataggaataagccaagaaaaggctttcaaaaaaagacactataattggactgtagaatcaaaacataaacatttatatctttcaaagataataaaatttatatttaatgaatcctataatccggctgcagctcgcatattgatgatttgtctgacaaaaaatatgggtgaattctgataattaaaaaacttttttaagcagatatagctgttcgatcttcattttaagttcaaaagaaccagaaactaaaaaaacgcagctatatttttaacacctatttattttcgatataatgaaatagacaacagccataaagggggagccttgttgaaaccatttgtatttatcacaaaaccgattcctgaagagattgaagcattcatcggtgaacattgccgttatgaagtatggcaggaggatacgcttccgagtgacgtgctatttgaaaaattaaaagaagcggagggacttttaacatcagggacgtccgggccgtcaatcaatcgtgagttgctggaacacgcgcctaagctcaaagtggtcagcaaccaatcagtaggctacgataacttcgatatagaagcaatgaaagaaagaggagtcgtcgggactcatacaccttatacactggatgacacagttgcagatctggctttttcactgattctgtcttccgccagacgtgttgccgaactggaccgttttgtcagagcaggaaaatggggaaccgtggaagaggaagcgcttttcggaattgatgttcatcatcaaacgttaggcattatcggcatgggcagaattggagaacaagcagcgagacgcgccaaatttggttttgatatggaagtgctttatcataaccgacatcgcaaacaagaaacagaagacagcatcggcgttaagtatgcagagcttgatacattgctggagcaatctgattttattcttctcattacgccgctgactgatgaaacctatcacatgataggagaacgcgaatttaagttgatgaaggattcagcaattttcgtcaatatttcccggggaaagacagttgatgaaaaagcactgattcgcgctcttcaggaaggctggatcaggggagccggcttagatgtatacgaaaaagagcctgtcacccaagataatccgctcctgcagctggataatgtcacgctgcttcctcatatcggttcagcaacagctaaagtgcgcttcaacatgtgcaaacaggccgccgaaaatatgctcgcagcgatccaagggcaaacaccgaaaaatcttacaagagaatttcaataaatcaaaaatccggtctgataacagaccggatttcatattacatacgctgaagaacagcacgcttataaatatgacgggtgacgatataataaagagcctggaatacaaaataaatgaagatgacaattacggcctcaagaaataaattggaattcagcatattacttaacgctgcatacgcaaagcccgcgtgaatcgtacctgcgataaatgggatgaagaataaaaatcctatttgctttccaaggatcgagtgaatctctttgtccgtaacccctatcctctttaacgctaacacctgcactctcgtatcttctatttccgtaaacatccgcaaatacagcatgcttccttgcacgataaaaaacagcacgctgacaaacagaccaataaacagcattaatgcaactccctgcttcacaatttgataactaggagcacgtgtttgaaaatcagatgtatgttctttcggcaccatgttttcaagcttttcagagacatccaccgtctcctgccaatgctcaagctcataacctaccattctcatctgttccttcagcggcacatcctgtgacagactgtcaaagctcttttcgctgacaaccaataaacggctgactccatcgacagacatcaatatccctttgttttgctgctttttcatgacataggaaagggtttttcctgacttcatatgaaatgctgctgtttccccttctccaaatgtgtctttcaccatcatttgaaaagaaacattaataaatgcttcattttcttgtaaatgaataactgggaaccctttttcctttgcgacttgattatagactttttctgaaatcagcaaagcttcagcttccatcttcttatttccatacggcaagtctgactgaaaagtgacaggaatccctgtggcatccaccttatacttgataacagcatgagcttttttcaatgtattctcagctgtctcaggcttcatgacctgaaagcgggaagcatccttttccacccaggaaacagactgaggaatgctttgctcctcctgcctttgtaaatcggaataaaacatatagatgacacctgtagctgttagtatgaccgctgtaatgacagaggttaaaaacagcatgcgtgcatgatccttcagcctgaatatcatgttggaacgcacaatgatattcgtgcctttgtagaagctgtgtttctttcggtacagcatgcggaaaaacgccacactgctttgtgtaaaaaagaaatacgtgccaactaacactaaaatcaaaattggaaatacccgaaacatcatgtcaatggcattggctgttgcagatagataataaccgctgccaagacatagcaaagacaatacagtgagccatttcgaataaaccggcaaacttttcggctttttggccgatttaatcagttcaatgatttccagcttccgaatccgtcccagtgataaaatgagcagcgtctgaaacaggatgagaaagccggcaattgtcatcacaaacgctttcggcacaatggcaaacgaaatcggcaccttcacgctgagcatccatgtcataatcataaaaaacagttttgaaaataacaggcctgctccaatgccggccgcaatcgccgcaagagaaataagtgactgctcataataaatcatcttgcgaagctgctgctttgatgtgccaaacagtgtcagcagcccaaactctttctttcttgcctgcaaaaacgctgaattggaatatgtgatgaaaaatatacaaaacacaatgatgacgacaagagctgcgctcaagcatgttttgacaaggcttccgccatatatattgtcttcattgacatcaggatgaaaaataaatgatgtgaagacaaaaaacaccgaaacggcaaacacacagcttaaaaagtaggccacataccgttgcagattcccaagaatgtttttacgggcgatagttctcaaattcatgaaaatcgcctcccaacacactcaaggtatccaatatactttgataaaacacctgcctgtttgttcctctgtgaatctctgaaaagaaacgtccgtctttaataaaaacaattcgtttacagaaacttgctgctgtggcatcatgcgtaaccaacagaatcgtcgcttccttttcctcattcagctgagccagtgtgttcatcacttgctttgccgattttgagtcgaggtttcctgtcggttcatcggcaaggatgagcgccggattgtgaataatcgctctggcacaggctgcccgctgctgctgtccgcccgaaacctcatatgtgcgatgatcgagaatgtgcttgatttgcagcgtatccgccagttcatccaatcgggcttccatttctctcagctttaccttatccaatgcgagcggcaagagaatattttcacgaatcgtcagcgtatcaagcagattaaaatcctgaaagacgaagccgagttctcttctgcgaaacaaagccagctcttggtcctttaacgttttcggctgaatgccgttgatcatcatctcgccctgggtcggcttatcaatggtagccagcaaattcaaaagcgtggtttttccgcttcccgacggccccataatcccgacaaattccccttttgacacactgagatcaaaggcgctgagcgcttggtatgatattgttcctttatttgaatagtacgttttcgataggttcgttgtttgcaacacgttcatgttctgctcctcctttttctttattataaaaaggaagtcagcatcctcccatcgaactttcttgcaattccgctccccaaccttacaatgctgtcacattcacgagggtgtcacttgaaaacacgatggtcatcacagtgccagccccttcttttgattccgcatacagcttatggccgagacggctgcacacctgttttgctaaataaaggcccattccagttgcctctttcatggttcgtccgttttctccggtaaaaaacgcgtcaaaaatccgcggcagatcctgtggcggtatgccgattccttcgtcggcaaccgacaatcgcgtctcatgtccctgtgtttcaatccggattgtaatagggtctcccacaccttgctttgaatattttaaggcgttgaaaaggatttgctcgacaacaaaggaaagccacttttgatcactggaaatctgaacggcatttggcggcacatgtaatgttggaaaaaggcgccgtttaataaactgacgtttttcctgattgatcagtgaacgaaccatttctgccaaatcaaaggtttgcggctttacatcaaatgcaaattcctccagccgagccgtttgcagcatcatatcaagaccgtaacgaaatctctcattctcatcctccagctcctctaagaacgtcggaaaagaggatgaggttccgttttttccttcctgaatcattaaggatatgacggataccggtgttttcatatggtggacccattggttggtgaaggtgtaatgctgtttttgctgattgatatattgtgagagcctgctttcgtattgctgcccgagtgcgttgatcatcttcgtccaaagcacttgctctcctgttcttggctttctggctttcaaagactgtccgatgtcattcgaagaagaggcttgttctgcaagctttttaacatatgtgagaaaggaaatttgccgaacataatcaacagcaaaacctgcggctaaaagagtaccgggcaaaatccatatgtacatcatattttctttggaaggttctgcgccgctctctacaatgcttaaatacgcaatcagcatggcggaccctatccctaataatgaaaatagaataatggctaagcggtcgatgagataagtctttaacactccgcttcatccttccgattgacttgaaattgatagccttgtcctctgattgtggaaatgcaatctgtcagtcctgcattctccagttttctccgcagccggttgacattgaccgttaacgtattgtcatcgacaaaatcaacgtcatcccataacgcctccaatagttcatcacgagagacaatttttttatgctccctcacaaaaatagagagaagctgaaattctttttgggaaaacagaatacggacgctgttccattcggcctcattttgatcaggataaatcgtcagcccgccaagctccactattctagattcctgcggcaaagagggcgagtattcaccatatgtgcggcgcaggacgcttttgattttggccatcactacctctaaatggaacggttttgtgatataatcatcgccgccattttcaatcgccattacctgattcagctcatcggtccgtgccgatataaagataatcggcgcattggaaatggtacggatttgcctgcaccaataaaacccgtcaaaaaaaggcaggttgatatcaagcagcacaagatcaggcttcatttctgcaaattccaattttatatcattcagctgttcagcaattttcacttcatatccgtatttttgaagatgaccgcccagcaaagaagcaatccgctcatcatcttccacaagcaaaatccgatacacgttgatcccccttatatgtacatcacgatgatttttctagaagattccaaaattattatagcatgtgcggaatagtaaatcggtctttttctttttgttatgatagaatgataaaggtaaaattttcataataggcaggtgtcgtgatgaagaaaatcatgctgtttctggcaatgacgtcaattctttcagcatgtcagcccaactataccgggaaatacatagaaattggggatacactaactgactataccaaagagtgttttaaagagaatgaaattccttataaatacgaaaagggaaaactgtatatcccagaagatgcatttgatacagcgatctacacttgttcataagaaaaagcttgcagataacctgcaagcttttcacgttacaaaaaatgagtatttaatttctcttcaaatcctgaagggccgatgtcgcttttttgaatgtcaccgccgttttcatgaatcgtaaaatggcgctctgacatgaccatccttccgctcggcgtcagctttgaggcaagcagggatttgttaaaaggagatttttcatgagagtgaatgatgtccttcatgttatctaaatcaccgagatcactctcttcaagagtaaaggcgtacccgatttgccagccttctcccttgtccatcagcagaacatggctgcccttttctgtctcttctcttttgattcggaatgacccgactggtgactgtaccgtttctccggaaagcggtatcggctggagcgccaggttgatgccgaaaccgatatcaacgaggtaatcgccgttttccgcagacagccatacagcagcatgcgtcccttctagtgcccatccctcttgattgcctgcataaaccgttcctcgaatgagcttcacgtgaaacccggcctcacgcaagacaaaataaaggaaaccatttagatcgtagcataggccgccgtgctgatctttgagcagacgtcgccatagctcttcttttgtgatcttataattctcttttgcaagtacggcacggttttcgaatggaaaacggtatgccattgctttgagaaaaaggggaagatcgccgaagctgacatgatctttctcccagccaattttctgaaagcagtcttttagaaagtcactcatttttatcacctaaacttcttcttgaacgtaagcagccagcttctccagcgcctcttgttcatcttctccctgggcaatcaaggtaacctcagtgcctgtgcttaccgcaaggctcatcagccccatgatgcttttggcgtttacttttttcccatccttctcaagaaacacatctgacgtaaaccggtttgcttcttgtacaaacaaagcagcaggacgtgcttgcagtcctgtctttaatcgaacttccactttctgttgaaccataagatctccccttttctttacggttattttaaagtgacggtttgccctgtccgcagctgttctgcgatttcgtcaagttttctcagcctgtgattgatccctgatttgctgattttcccgcttgctaccatttcccccagctctttcagcgtcacttcctgataatcaatccgaagctgcgcaatttcccgaagtttttcaggcagcgcctccaggccgattctttcatcgatgtatttaatattttccacctgtctcagcgatgcgccgatcgttttgtttaagttggctgtttcacaattgacgaggcggttgaccgaatttctcatgtcccgaacgattctgacatcctcaaatcgcagaagcgaattgtgagcaccgattacgtttagaaactctgtaatcttttcagcctcttttaaataggtaatgtagccttttttccgttcaagcgttttgctgtttaactgaaactcatttaacaggtcacataatgaatcgttatgctccttataaagagagaagatttctaaatgatacgaggaggtttccgggttattgaccgaacctcctgccaaaaatgctcctctcatataagaacgcttgcagcatctctttttgaccagctctttcgaaatacttcgttcaaacacaaaattctccccgagtatttttaaatcctctaagatcgcttttgcattttctgaaaaacgcacaatatagacgttattctttttcagccgcattttctttctgaccagcagctcgaccgacacatcatattgttttttcagcaatgtatagatgcggcgggcaatcgccgcgttttcggtttgaacatcgagtacgagatggcggtttgtaaatgataaagctccattcatccgaatgagtgcagacagctcggcattaatgcagcagtccttcacttccagattcgttaattctttttttgtttctgatgcaaatgacatatagccacctcatttcaaggcttcattctttcagtaaatcaacaagaagagaggccactttatgtgtatcgtgacgtattacgtcatttttatacgttacaatttgatctctgatgacttcaagccccatcgctttcagctcttcgatatcaaaatcaacaggacgcgccgattccatttcgtacttacgttttatttcgtcgggaatgtcttcactgttcactaatatcgtatcaataaaaccgcagcccatatgctgattgagcgctttcacatgatcagcagcggtgtaatggagcgtttcgccgggctgagtcatcacgttgcaaatgtatacttttttcgccggcgcctttatcacttcttccccgatttttgggacgagcaaattgggaagaatgctggtatagaggcttcccgggccgataataatcaaatccgcttccctgattacgtctattgtttccggcagcggatcaatctgttcaggcgtgagaaaaacacgcttaatgcgctgtccgtattctgggatcgttgactcgcctgagaccacgcggccatcttccatctcagcatgcaaaacgacactggcattggcagccggcaaaacctttcctctgacattcagcaccttgctcatttctgtgacagcgtgaaaaaaatcaccggttatatttgtcatcgctgccaaaatcaaattcccgagagaatggcctgttaagtcattccctttattgaagcggtgctgaaaaagatcttcaacaagcggctccacatcggataaagcggcaagcacatttctgatgtctccgggaggcggaattttcagttcattccgcagacggccagagcttccgccatcatcggcaactgttacaatggccgtgatgtcaacaggtttatgctttaggccccgaagcaatacagaaagacctgtaccgccgccaaagattgcaattttcggcttttgtcccatcttatttccggcttctcttttcaatgtcccggtgagtaacatgagtatagtaatcctttttgaaataatcagctaaattctcggctaatgtcacagagcggtgctggccccctgtgcagccgatcgcaatgacaacctggctttttccttctcttttataagatggaagcataaagctcagcagatcaattaatttctcattgaacttttgtgtttcattccacttcatgacgtaagaggaaacttctttatccttgccagtcagcggccgcatgctttcgatatagtacggattcggcaaaaatctgacatcaaagacgagatctgcatcaattggaataccgtatttaaaaccaaatgacatgacatttacggtaaatgtctctccttggtttgtcgcaaagtgcttcacgattttttcacgcaaatcacgcggcttcatgtcagacgtatcgtaaatgatttgagagcggccttttaattcctcaagcagctctcgttccagcgcaatgccttcaagcggcaggccagtcgctgccagcggatgcgagcgtctcgtttctttatatctcgtgacgagaatggaatccttcgcgtccaggaataaaattcgcggtgtgatccacggattttcggccatttcatccagcgcttcaatcagccggtcaaaaaattcgcggccgcgcagatccatcacgagcgcaactttgctcattttcgaatttgattccttcatcagctctaaaaacttcggaagcaatgaaggcggaagattatcgacgcagaaatagcccagatcttcaaagctttggatcgcgacagttttccccgctcccgacattccagttataatgacaagctgaatatcatgtgattcactaacactcatctttctcccccctgacttgtctttctatttgatgtgctgcgggtctaaacgataactgagtagctcaaattccggtgtatacgtaaatgtgccgtgcagcagcccttgtcccttcatcataaaatcaaggatatggccgtctccaggggccataggcaggttctgaatgtcattgacatcgtgccactgcagtttgccctcctctgattcagacacattttgtcctgtataagaatcagcgacaaacgtaaacatcatccactcggagacaatgtggtcaccgtctttaataataaaggtaaaaacgccttttaattgaggatttatgatatagataccagtctcttctctgtactctctgatgacggagtctctgactgattctccgctctccatcttgccgcccggcgcgacccaccagccgcgtctcggcttttgaagcagaagaactttgtcatccgtctgaagcacacaatttgtcactctttgcaagtacgtcacctaaccttcgtcctgtcatcgtctatttattataccgcttcaagatgcctcccacaatgaagagacattgacaatcttttcttctattttacagcatattcattccttaattcagatgattttgctgtaactggaattctcttttatttatggacaaaaaaaggacacggataactggagaatccgtgccaaaaaagtgtattcattataaaaagggggtcaattactttattaatcataaccgaaaagcattacacatgtgttacagcggaattaaaacccagtaacgtaatgtgaaactcgtatgacagccctttttattttaaggttttcagcgtttcttggagctcttcgacataatgctgtacgctttgtgccgcaatgcttccgtctcctgtagccgttacgatttggcgcagtgatttttcgcggatgtctccggcagcgaaaatcccttcaaccttagtttccatgcggtcgtttgtttcgatatagccttcttcattcgtaatgcccaggttttcaaacggtttagacagaggaagcatgccgatgtaaatgaatacgccgtctgttttgaattcactttcttcaccggttaccgtatcgacaagcgttacgttaccgactttgccgttttcctcatgaatttccttcacagttttgttccataggaagtcaactttttcattatcaaatgctctcgcttgaagaatactttgagcacggagtttatcacgtctgtgaacaatcgttacttttgaagcgaaacgagtcagatatacgccttcttcaaccgcggaatctccgccgccaacaacgacaagttctttgcctttaaagaaagcgccgtcacatactgcacaataagatacaccgcgtccgcccaattctttttcgccaggcacgccgatttttttatattccgcacctgcagcaatgatgacagcacgggctttatattcctttgaaccagctttgactactttgtactctttgccgtcaatgacctctttaatatcgccataagcgtattcagcgccgaattttttcgcgtgttcaaacattttgttagaaagctcaggcccaaggatactttcgaatccaggatagttttctacatcttccgtattggccatttgtccgccaggaattcctctttcaatcattaatgtcgataaattcgctcttgatgtgtatacagcggccgtcatcccagcagggcccgcgccgattataatcacgtcataaattttttcttctgacacactattcactccttaaaccatcttttcaagtttgggctctttcttataagataagaatccccatcaaacgtattccttacccatatcctataaaatctcatggtgatacgctatttttttgctcaacacgattaaatgtattcgaaaagggtatatgttaataaagaaagagccttctgttttagaaggcccttgtcatatttattattgaacaacacgtcttacaacgcctttaaatgcttttttccagtaaggattgctcatagagtcaacagatacgccatgagatgtattgtcgtttaggaaagtaccgtttcctaagtagattcctacgtgtccatttgttttgtaagtgtcaaagaacacaaggtctccgcgtttcatttcagacgcgctgacagcttgtcctctgccaactaacgtatcagtagttgttccgcctacaggtccaaggttaacacctgcagaagcgtatgcccagcgtacgaatgatgagcagtcaaaaatacggttgttgatatcagattggctgcgtccgccgccaaacttgtacggagattgtcctacaatgcttgaaccaacgctgatcgcgccttcaattccgccagagttgctgataacagtgccgcctgaattgctgtttgagccgctgctcttcttagaagatgagccgtttgacgaactgtttgatgaaccgttagaagaattgtctgaagaatcatcagatgagcttgcttttgctgattcagttgtcgccgtttgactgtcatctgtttgtgtttcgtcagatgctttttgtgcttcttcctgctttttgatcaaagcagccgctgcttcttgttcttttttgatgcgtgcttgttcagcttcagtatttgctttttgatttgcaagttcagacgcctctgattttaattcagaaatcgctttagccgttttcttctggcttgcttttgcttcgtcgaaaagcttgtctttttcattaagctgtttatcaaggtctttttgcattgtttctaatttagccaatgcagcttgaacttctttcagcttgtcattcaaatccgcttcagaatcctcgagcttcgctttatcctgctcttgctgtttgattaaatctttgtctgcgtccacaatagatgaaaccgcagtcgcacgagagataaagtcaccaaagcttgttgatcctaaaagaacatctatgtatccttgagatccgccgctttcctgtaaagaacgaacgcgttttttcaggatttcattgcgtttttcgatgcgtgcttcagtttctttaatctcttttttcagttttttgatttcttcttttgttttatcattttcttcttttttatcttcgatcttgttacttgtatcaagcgccttagcgttaatgtctttcagttctttttcaatctttgattgattttcctgaagttcagttaattctttttccttcgcttcaatgctggaagcaacctcagattgcttgctttcgattttttgtttcttttcatctaatgtttccgccgatgcagttttacttgtaaatgggatcaaaaaactgcttgtcccgatgacggaagccaaaccaagtgtcaataaactctttctcactttttatatcctcccttttactgtgaacctgtcctcatttggaatcgtattttgaacatcaagtttcgttcctcatactctacgaggaatgatggttgtttatggttaattattctgtgcatctcttattctggttgtatagcgtttatttcacatcatatgtaaaaaacactaattccttatgtacgagaatcattataccatcaagtttcgacaaattagcgataaattttattacatttatgtttcaaacagatgtcaagtcacacatcatttgtcatttttcttaagcgtgcaaaaaaactgtcgatattattttttaaatataatctatcaaacaaaaaagagtcgattaaataaatcgactctttaaaatttactattctagaatatcatcaatatatttcatatatttcgtcaacgttgccggagagatgccgaatcgggccgctgtgtcttttttcgtgtcttgcttgccatgggcttctttccaaatataacagatggctgctgcccagcctttctcattcttcaacggagcagctgcacgaatttgctggatgacatggaaaacccagcagctcatgacttctgttttcatctcttctttttcagcttgctctaatagtttgaccgtttgataggcgaaaagtgcatcctctgaaacgtcagcagccgcggaatctccattcagaagcagctttacaaaatgattttcaaaaggagcggtgattctctttgagcgtatcaccgcttcaagatgctccgtttctccctttgtgctgctgatataataggctgcgagacgctgttccacagatgaaggaagagcttccctccgctcaatccaaggcgccgggcggtcttcgccgggatattgcgactcgacttttctccagatcgtctcggcaaagtcggtatgtcccgtaaaataagcagagcaggaaagccagtaaaagaaggtgtcgtcaccttcaaagccggttttatataatgatttgagccatttatatccgatctcgtagcggccgacaagcgccaaagtagcacccaatttataacgctgctccattagcatcggatagacattggagagctgatcactcaattccaccactttttcgtcttctctttcataatagtagaaaacgagaagattgcataaggcgtgaagatttccttcattatgagaaagcacttcataagcggtttgcttcgcttttacaacgtttcctgaatagaaataggcaagcgcgagattgttgtatgctgaccaaagctccggatattcagctgtgatttcctcaagcgccgcaaccgcttcagcaagctggccgctttccagcaatgactttgcccgatcctgtttcaccagcagttcatcctgatcatacaacgaatcctcaatgccgtcgtctcctaaatcgagcaaatcaagcagactatcgttttcttcggcgaattcaccatccgggtccgcatcagaataagcggccgcttccttataagcttcctggaagagccccagatgggcaaagttattcgctttaaagtaatggcactccggcatttcggcctccagatttgccatgatatagtcaagaagatcgttcgactcttgatattggcccatttccgaataaatgaccgcaagctgtgaaagcatctctgaatcctccggctccaaatgaaccgcgcgctgaatcagtttgcttgcccgttttagattgcgctctttatacgctttcaagcctttatgaaaaaaatattgtccatcttgaagcagctggacaatttgtgcgtgatttttatgttcagaagtgtgttttcccacaactaccctccgttttatacaatattaccgtcagtagtataccataaatcgtaagcccctcaatagttcaaaaggaaggattgggaaaatccctcctcttttttattggctgattcgaccagaatttacccggctttgttttctaagtccgcattcattttcagctgctgttcagcaaaatccctataaagaccatgggaagccattaactcatggtgtgttccacgaccggtaatttcccctttttcaacaaacaaaagctggtccgcatctacaacggtagataggcggtgagcgatcacaatcgttgtgcggccctccatcagcacctcaagcgcctgctgaactgatttttcagattggctgtcgagacttgaggtcgcttcatcgagcataagaatgcttgggttacggagaagcgctctcgcaattgcgattctctgcctttgtccgcctgacagcataatgccgcgttcgcctacttctgtatcaaactgattcggcagctcctttataaaattgagcgcatatgccatctccgcggctttttcgatctcagcatccgtcacatctcgttctaacccgtagcaaatattttctctgattgacccggacattaacgggctttcctgcgatacatacccgatatgctccctccacgattcaagcgagtaagtatcgaccggctcgtcccccagtcgaatggtccctgcagtcggagtataaaaacgttcaagcagcttaaacagcgtcgttttccccccgccgctcggaccgacaatagctgtgactttacctgcttcaatgacggcgctgatttcttttaaaatcagctgatcaggcttgtatccaaaagacacgcgatcaagctgaatagggagatgcgcattttcaatttgttttcctgtcactgtatcttcttcttcctctgctaaaatctcaatcattcgttctgttgcaccgattgatttttgcagctgtgtgaaaaacgttgtaatctggcccatcggcattataatttgaaacaaatataaaataaaagccacgagcgctcccgccgtgagttcgcctgaagatacctgcatgccgccatatccgatcactgcgacaagcgctgccattagcacgagtgagataagcggaccgacaagtgattgaaccttagcttctcgaacgccaagcttaaataatgatgaaatccctgttttcccgcggccgtattcgacatcctccgcatttgaagctttgacaagtctgatttccgggagaatttgattcagcaggcctgtaaaacgggctgtttcatcttgtgtttcccgtgaaatggagaacattttccgtccaatcggcaccaaaataagagcggccagcggaacgaccactaacacaagcagtgtcagcttccagttcataataaacaagattgtcaatgatccaatgacagaaatgatgcctgtaataaatccgctgatatgggttgtaatcaattctttgaccaccatcgtatcgttcgttacacggctgactgtttctccggaagcatttgtatcgaaataagagacaggcagcttaattaatttcttccataataactcccgcagcccggaaatgattttttgtccattatagttaagcgcataggtggcataagcgcttaaacccgcctgaacgaaaaacaccagcgcgatcaaaccgatttgcgtgcctgacagatttgacatagaaaaaccatcgacaagctgcttcgttaataatggaatgagcaggctgaccagcgtggttactacactgagggcaagcgcaaaggcgagctttccataagaaggattggtccgtcttactaaggcaaaaaagggtttcaatttacttttagatttttgtttcttggttggcatatattttcctcctgtttcagcgttcagaaaggtgaaaagtcatagcaaaaggatgatttttactctttctcaatcatatcaatggagaaagactttttcagtatatttttgccgtgatcaaaataaaaatctcccactcattgtttgaataggagatttttgtgttagacatctttcactggcttcttttttctgtaagtcaatgttacatcctgctgtcgcaggtcttctattatcattttgtaccgatcaacttttgcggtatgttcttcttttatcatctgaagggcagcttttcgtttttcgctattagactcaagctctttttttattttttttacaatcaaccctttttgccctttgatttcctcttttaatgaagactcaaatttctttgtcaggctgagaaagtcgttgatcggttgattgagggtgcccgctttccccttcatttcatcttgggtaagaaacatataggtcgttgatacaatttctgtttcactttctgaaaataaggaagtcactcttcatattcctcctaagactgaaaatcaaataactgagaaatcatttcttctttttcaaacagcttttcaatactctcgcggatatttttgataaaatctcttttttctgttgtctgtttttttaattcagcaacaattccatcattagcaggaagcgcacctgtgtggaatgattcatgaactgagattttctccaatttatcgaatgtgtggctgaaaccagctgcaagccggaattgaagatcgaaggcataatgcgaagggttttcttccatatgatgaatagccgtgatgatcgcctgctttttgtctatgaagtcttcatcgatttcctgactgtaaaccttctggtacttagaaatcgcatcttccatatcttcaacgattttcataccgttttgatagattctgacagcggatgagagattgacttgaatcgtttctcccgagccactcttccctgtaaaataaatatcggagcctttatagctgaagcctttttcctttgacaaggcgttgagcatttgaacgatgctgtggccgtcgacgataagttttagtgcgtcttttgtttctgtgtcgagtgttttcaatgaggacagaattgattttacatagtccactatttcaccaacgtcttttaaagcttgcataaattggccatattttagatggtctatgaaatgttcgtaccgtgactctatgcctcgcatactcgcattaatattcgttaattcttttttgatgactttcttttgcgtttcatcaatataaccattttcagctaactgatctacgaccggtccgctgtttctcaacaaggtatgaagaaaacctaaaaacgacggcagttcctcttttattcggccatacatttgcttaacatcatcaaaatgctcatataggacacttactttctttaaagcgccgtctgtgtttttcactttttcaatcaggtctatgtctatcccgctggctgcctttataaaaccgttcaagccgtctttttcatagtcatccttatatttttgaaggaatttttgaattgacctcacatcttcgtcaggaaccccatccataatgtttcggatgccttttacacttgtatttgtatctgccatcttcacatcaccgaatgtaataaaatcggccttgccgctgactccatacagcgggtcatcttttgagatgcgctgagtgatgtttgttgttacgcctttgtcttcataatatttttggatttctttttttaacttttctggcgggatggaatctatatcttcatatttataactaaatttcctaataacatatctatataaactttcatcagtttcaagtaattgatcaatattgacttgagctccatttaccccataaacttcatcatattctccatcaatcaattgcaccataacttggttattatttgcaagtgaatgtcctaaggcgaatgtttttaaatcctcagagttacctgctgctttctttgctttgttagtaaactcctttgtagcctcatactgactatgatcaattcctaaaaaaagaccaaaaaagttatatgaccaatccttattatcggcactaccttctgaaataatctgaagctgatcaatatgttttttctcatctattatatggattgccgttccatcgtaacctgattctctggtcgaactttgtatacttgtattctgatttacaagttcattggaggtgtaaatttcaattttcatattctcaggaagatcgtggtgggtttcctctttataaattctgcgtatatctgcttcgaaatccttcttagctttcttaacttcactcgcaatagttgaggcaaacttttgtttatagtcatattctaaatcaattaaccttaactttacgttctcattctcaaatacatttttatttcccatcttatttctcctttttatctattaaaaaggtgatagaattaattaatttctcaactttatttttagccttttcttcatctaaggagcatggttgattttcatttttgcatccaagggtaaaggcgtattctactcctaggttatcttcctctgtagacttaacatatccaaaataactgtatgaataattatattttctatcaatatcgtcaaagatgtcttttttcttggcagtgtaaatatccgttttctttttgctgctttttttgtattcgcctttataatcattttttccactaacaatatctagcattgtcttaggttcattcgcaaaactttcttctttgtaatatgttacatggccatcaaacattacattggtgtctttatcataactattaaatccaatactttctttgtttttcccggttaacgatgatcttcttgatagatactttccatcctccggaaacaacatcctaaaccctttcagcttagattccagcaaataatatcctggttcctcttcttttgttgacaccatgtactctctcgttttctcgtcctgaaacgcaggtacttgaggcagatccttgggatccatgtcttttggttttaccgcttctgttttattgtcatttgtgctgtttttatcattgtcattcatactgcatcctcctgtcagggcaagtaataagctgaagcaaataaagatgatctttttcattacgaacctccacgggttttgtgagaatagtattctatttttatatcaaaaataattctattgacctggttaagagatgattatttcatcctttttcatgttacatcatggcggaatttggataaataggaaatgagactcggttttgatctccttttattaactaatcatatataacacccaatataaatctaaatacctattacttttttcacaaaacaaaaagagccgtatcatccggctctttactcttcaatctcagaatggcgttttttcaatacgtcaagcacatcatccagcggcagggattgttctctgagcaggacaagcaggtgatacagcaggtctgccgcttcccatttgagttcctcatgatcccggtttttcgcggcgatgatgacttcggatgcttcttctccgacttttttcaaaatcttatcgacgccttcacggaagaggtacgtggtgtaagctccttcaggcatttccgcttggcgttccgcgatcacccgctccagttcgttcatgatgccgaatcggtccgcggcctgttcttctgtttgttcctttgtaaaacagctgtagctgccagtgtggcatgccgggcctgacggttctacgagtacgagcagcgcgtcttgatcgcagtcataccggatacctttgacggcttgcgtgttccctgaggtttctcctttatgccataacgcttggcgtgagcggctgtaaaaccatgtttccttcgtttccagcgttttttcgtacgattccttgttcatatacgcaagtgtcagcacttctttgcttgccgcatcctgcacgatagcaggaattaatccgtcctcgttaaaacgcagttcatctgcctgtttcatctcacattcaccccgtactctttcaagtatgatttcacttctttaatcgatgtttctttataatgaaaaattgaggcggccagcgcggcgtcggcttctccttttgtaaaagcctcaagcatatgctgtgcgtttcccgcgcctcccgaagcgataacagggacggggacagcttcggaaacaagctttgtcagcgtgtggtcgaaaccttttttctcaccgtcggagtccatgcttgtcagcaatatttctcctgccccgcgtttgacgccttcttttgcccacgcggtgacctcccaatctgttttctttctgccgccgtgcgtatagaccttatatgtgtcagattctttgtcatacttggcatcaatggcaagaacgatgcattgcgaaccgaaaaactcggctccttctgcaatcagctcagggcggagaacagctgccgtgttcaccgacactttgtccgctccggcacgcagtatcgttttcatatcactgagctgattgatgccgccgccgactgtaaacggaatggcaagcttcgcggcaacctgctccacaacgtcaaccatcgttttgcgtccttcatgcgaggcagaaatatcaagaaaaacgagttcatccgcgccttcccggtcgtacacttccgccagttcaactgggtcaccggcatccttcaattcgagaaattgaattcctttgacaacgcgtccttctttgacatcaaggcatggaataatccgttttgtgatcatttgcgcttcaccctttcaagcgcctcacacagcgtaaactgattggtatacagcgcttttccgatgatcgctccagagacgccgtccgcctcagagcgggcgagagcttcgagatccgcgacggagctgactccgccggaagcgatcaccgatttccccgtttccttagcaagctcgaccgtgcttttaacattggggcctgacagcattccgtctgtcgcgatgtcagtaaaaataaagacttccgcaccttcattggctagctctttgcccagttcagttgccttaagggttgatgtttccagccatccctctgttgaaacaaaaccgtttctcgcatccagtccgattgcaattttctcgccatattgtttcagcatttttttgacaaacggagggttagaaactgctgagcttcccaggatcacccgatcgactcctgctgataaatattcatagacgtcattttcggaacggatcccgccaccgatttcgactttcaggttcagcttttgcgtaatctcaatcacatggcggtcattcactcttttcccttctttggccccgtcgagatcaacgagatggatccattcggcaccctctttcgcaaataactcagccatgtcgtacggtgaatcgccatatatcgtttccttattataatccccttgaacaaggcggacacatttgccgtttctcatatcaattgccggatataatgtaaaagcactcattttttcaccttctgttctgctgccattttcgtaaattgagttaaaatagacattccgaccgtgctgcttttttccggatgaaattgggcgccgaagacgtttctttttccgactacagcaggcactcgtacaccataatcggcgcttgccagaagcgcgttctcctccatcccgtcaatgtaataggaatgaacgaagtaagcgtagccttgttctgtttcagacagcagcggagattcgttatgaaaggaaaggaggttccagcccatatgcggaaccttcagcttgtttcctttttcatcttctgctttcagcctgactgcttttccttttaacagcccgagtcctgaagcggtgccgttttcttcgctttcttcaaataaaagctgcatgccgaggcagatcccgagaagcagccttccctctgagaccatatcgtgaatcaattgatcaagcttcgtgtagcgcaaattgtccatcgcgtctccaaatgaaccaactcccggcaaaatgaaggcatcagcttctttcagctcctccggcttttcagaaacaaaatacggcacgccgacacgttcaagcgcctttgagacactgtataaattccccattccgtaatctatcacgccgatcatttacagcatccctttcgttgacggtattcctttaactcgcggatcgatcgttgtcgcttcatcaagcgcacgtcccagtgctttaaaaacggcttcaatcatgtggtgggtgtttgtgccataatgaacgatgacgtgcaggttcattcgagcttcgagcgccagcttccacaaaaattcatgtacaagctccgtatcgaaagttccgactttagcagccgggaaatcagcgcgcatttctaagtgcggccggttgcttaaatcaatcacaacttgagcaagtgcctcatccatcggcacaaacgccgatccgtagcgtttgattccttttttatcgcccaacgctttgagcagcgcctgccctaagcagatgccgatatcttcagtcgtgtggtgatcatctatatcaacatcgccttttgcgttaatggaaagatcgaattggccgtgtttcgtgaataaatccaacatatgtgtcataaacggcacatctgttttgatatccgcttgtcccccgccgtctattgtaaatgccagttcaatatctgtttcgtttgttttcctgacgcgttccgcttttctcatttagaaatcctccgttctctcgcttcaattgatctggcatgggcttctaacccttccagtctggcaaaagccgcgatgctttcggcatgttcttcaaaggctgattgactgtaagaaataatgctcgatttcttttgaaaatcagttacgtttaatggacttgaaaatctggctgttccgtttgtcggaagcacatggttcggtccggcaaaataatcaccgacaggctcagggctgtatctgcctaagaaaattgcacccgcatgtttgatactgccaagcaaagcttccggagactgtgttatgatttctaaatgctctggcgcgagtgtattgacagtattaatcgcttccaccattgtttccgccacatatatacaaccgtaatctctcactgaagcttccgctatttctcttcgcggcaaggttttcagctgcttactcacctcggctgaaaccgcctcggccagcgccatggaatctgtgacaaacacacatgagctgagcttatcgtgttccgcctgtgacagcagatcggctgcaatttcgctcggaatcgctgtttcatcagccagcacgacgatttcactaggtccggcaatcatatcgatatcgacatcgccgaacacttctcgtttggcaagcgcgacataaatgttgcccggacccgtgattttatccaccggttcaatggtttctgttccgtatgctaacgccgcaatcgcctgagcgccgcccattttgtaaatatcttttatgcccagctcggctgcagcaaccaaaactccaggagacagcagaccgtctttttccggaggcgtgacgagaacgattctttcaacgcccgctacgagcgccggaatcacattcatcaaaacagatgaagggtatgcggccgttccccccggcacatatacaccggcggaatccagcgccgtcactttctgccccagcattgtgccgtcctttctgtgataaaaccaggaggattgcagctgtctttcgtgatattccctaatattttcgattgcctgcctaatcacctgaagaagacgtgaatccagtgaggtgtatgcctcctcaaattcttcttttgtgaccagcggactgtctatttcgatgccgtcaaatttcgccgtgtagctgcgaaccgcctgatcaccgtttgctttaacatcttctataatggaccggaccgtctttctttgctcttccgttccggcatcgatggaacgcttgagagaaagccgttccgctccgctgatggttttgatcttcattttgccgtctctccttccacaacgagagataggcgggatgccatttcgtcaatcacatcgtctttcatgcgatagcttaccgggttgacaataaagcgagaggtaatgtcacaaatgtgctccgtttcaacaagcccattttctttcagcgtctgtcctgtggaaacaatgtccactatccgatctgcaagcccaatgagcggagccagttcaattgaaccgttgagcttaataatctcgacttgttctccctgctctctgaaataactggaagccacattcggatactttgtcgcgattcttggcgctactccgctccagtctgtattcggaagtccggcgacagctaagtggcatttgctgatttttaaatccagtacctcatacacgtcgcgttcctcctccagcatgacatccttgcccgcaattccgacgtctgccacgccatgctccacatacgtagttacgtccatcggcttcgctaatatgaaacgaagattttcctccggcacatcgatgatcagttttctcgaatcttcaaactcctcagggagcctgtagcctgcctgcctcagcagccctgccgcttcttcaaatatccggccctttggcatcgccattgtgagtaacttacccattttgctcttcctttctggcaccgataaaataagtgacgtttgcaaaagattttgtcatctggtcgatattttctattcccgataaatcttgaagaaccactttgttccctttcatgcgttcttcattcgcataagcgatggcttgcgcccgctgctctttgctgaaaataacagcgtctatatcacaaggttcttctttcatatgaagggcttcaatcagccggtcgatccgaagcccgaagcctgttgccggtgcaggtgaatcaaaatggcccagcagcttgttgtaacggccgccgcttccaatgacaaaaccgacattctcggcgtacacttcaaataaaatccctgtgtaatagctcatgtggctgaccatattcagatccaggcggacattttccgtacatccgtaatcctcaagaatgtcccacagcgccttcagctcatcaaccacgctttttccttgcgcagaatcgacgatttcctcggcacgtccgcatacttctataccgccccgcagttcaaggagctcaagcagcctgcttttatcaatggaggaaagcgggagagacttgacatgctctctgtaaccgacgtagttcttttcatataagaacctccgcagcacatcagctcgttcaacgttcccgagcacctcaacaaacaaagcatccgcaatgccggcatggccaatggcaattttaaaggatgccagcccagcgtttttcaatgccccgacgactaaagcaatgacctccgcatccgcgctcgttgtgccgtcaccgattaactccactccgacctgctcgaactcagccggacgtccgccttcacgctcctgagccctgaatacatttgccgcatagccgactcttagcggatgaccgtgtttcagaagcttcgatgccgccacccttgcaatcggccccgtcatatccgggcgaagcaccaatgtcttgccgtcctgatcaagtagcttaaacagctgctgctcttcaattgctgactggacgccaaccgtatcgtaaaactccagtgtcggcgtttccataaattgatatccccatttatcaatcaaatcggttaacgatcgtctcaccttttttttcgtttcgtataaaccgggcagtgtatctctcatgccgtgcggtttttcaaacataaacatcaacccgagcacctccgctgttatcttatgaaggaaaattccgaatcctttagttcgctaatatgataatatgttagcagatgaaagaatgaaaatcaacgcttaacttcagtaaggatatttttagttcaaatatccttctcctcattatgaaaaaatcatgaataatgtattaaaggtacgtaatatctcaaattctttatgtttggcatgctataatacaaatcaaatagagaacaaggagataaagatgaaaacactgcgaactctatgtgtcctgatgattctttcaggcgttatttttttcggacttaaaatagatgcaaaagatatagatattccttttttgaacagccttaaaaaagtggtttctgatagcgatacagatacaggtgcgaatagcaaaaaggagctgaagggaagcgcaaaaccgctggatgtcatcctttacaatcaaatggacgcaccccggctctataacggctgtgaagtaacaagccttgcgatggtgctgaattacgcaggatacgacgtgacaaaaaacaccctggcaaatcaggttgccacagtgcctttgacatacagcagcggattaaagggtgatccgaatgacggatttgtcggggatatggcgaatggccctggtctcggtgtctaccatcgaccgatctatcagctggcgaaaacctatgcgggagacaaagtgtctgatctgactggaaaaagcatttctgctgtttatgaacagcttgaaaaaggcaatccagtttgggttattacgacagccaactttacgccagttgacaacatgcagacatggaaaacaccaaacggaacgatagagattacgtacagcgaacacagcgtcgccgttacgggatatgatgataaatatgtgtatctcaatgatccgtatggctataaaaacagaaaaaccgatagaacaagctttgaaaaagcgtggaaacaaatgggcagccaggccatagttattcaaaagtaaacgcctgaaagccgcactatgctctatcctgagcaaatacgacaatattcatgctttttgtttcaatcggtaagatcgattcattttccatttatcatccagaattatctttactttcaggctgtctgtttttatgattaaagcagattcagccttgccccgatctatgtgagagaagccggtgcaagtcgctgacgcttctcttgcaaaaaatgaaagatatccggggaggatttatcattgaaaaaattcgtgtctatcctatttatgttcggtttggttatggggttcagccagtttcagtcatcaaccgcttttgcagcagacaaagtggtgcacgaaacaattatcgtaccaaaaaatacaacatatgacgggaaaggacagcggtttgtggcagggaaagaattaggcgacggaagccagtcagaaaaccaagaccctgtttttcgtgtggaggatggtgcaaccctgaaaaatgtggtgcttggcgcccctgccgctgatggagtacacacttatggaaacgttaacattcagaatgtgaaatgggaagatgttggtgaggatgcgttaacggtgaagaaggaaggaaaagtgacgatcgacggcggttctgctcaaaaagcgtcagataagatattccaaatcaataaagccagtacattcacagtgaaaaacttcacggcggacaatggcggaaagttcataagacagcttggcggttcaaccttccacgttgatgtgatcatcgataagtgcaccatcacaaacatgaaggaagcgatattccggacggacagcaaaacaagcacggtcagaatgacaaatacacgctactctaatgtcggtcaaaaatggattggtgttcagcatatttacgaaaacaacaacactcaattttaaccaaaaaagtccgctgatgttattcagcggactttttcaatctttcttgcatttcttccttcgtatagatgatcctcatcggatttccgccgacaaatgcgccggcaggcacgtctttatggacaagtgttccggcggacacaactgcgccatctcctattttcaccccgggcagaatggtcgtgttggcaccaatcatcacttcgtctccgatcagaactgtgccgatccggtattcgtgaatcaaatactcatgggccagaatggtcgtattgtacccgatgattgtatttgttccgactgagatcttttccggaaacatgatatctggcatcaccatgagggcaaaggatgtctgatttccaaccttcatccgcagaaatgtacggtacagccagtttttcatccctataaacggcgtatatctcgcaatttgaatgacaatgaaatttttgacgacctttaaaaaaggtaccgtttgatagacatgccacagtgagttggcccccgagaccggatgacgatctgtttttctcacagattacttcactccaacgatttgtaatagatcactcattttctcaagcataaaatcaggctcatgcttcgccagcatttccggccctttaatcgtccatgcgactcctgccgtttttgtaccggcgtttttgcctgccagcacatcgtggtaattatctccgaccataatggcttcctcgggcttgcttcctaactgtttcagcgctaacagcacaggctcgggatcaggctttgcatttgtcacatcatcaagggtgacaactgtttcaaagaattcgccgattcccgtgagcttgaggcccatattgacagtatctcttaattttgttgtcacaattcctaatgtaaagccggctttttttaatgcatccagggtctcatataccgtttcatattcagtcacgagtgaatcatgcatgtcatgattgtacgctctgtacatagcgatcatatcctcgcatttatcagggtccatcgaagagaacgtttcaaaaagagacggcccgataaatgcaaggacatcttctcgtttatacttgctcggataataatgctccagtgtatgcaaaaaggacgcgataattaattcattcgtattaataagcgttccgtctaaatcaaacagaatcgtcgttacttgtttgtcactcatattgcttcctttccaaccgctgagggtttccattttttccacgtgtgcgcaatagccattgtcagcagaactgctgtggtgacacgaatcaaaagaagcggccagactggtatgccgagcggaataaagacaagtgtatcttccacgaccgcgtggcaggcaacgagaaatataaatgccaatgtcatatcccgcttgctcacgccgtcatcctcgacagctttgatcatgacacccgctccgtaggccagaccaatcgtcagtcccgccaccatcgtcatagacgtatttttattcatgccaagcagctgcgtaaacggcgacagccacctggaaaaccgatgcagccagcctaaatctcttaaaaactggatgataatcatcagcgggatcactattgccgccagctgcaaaacaccaagtccggctttcgttaatgcttctgccaacattcctagccagctgtctggcgccgcgctcttcgcagcgataaaaccgtactgcgccgtttcctttccgccatgccaaatgaggttgatgacgatggctgacacagcggccaaaccgatgcgcacggccaatatgacgccaattctgataccaacctttgcggcaactgtcgattcgataatcaagttatgacagaaagaaagcataacagctaaaataaagacttctttcacagataaatccaatgttaaaatcccggcaattcccgcatacagattcagcatatttcccagtacaagcggaatggccgcttcaccagaaagcccgaagagacccattaccggtgtgatcagccgtacaagccaatccatgacaggggtatgctgaagcaaagtgaccaatagcgttaccgggaaaatcactttacccagcgtccatgttgtttgaaaacctgctgcaagaccggccagaaagatcttcttcatccctcatcccctttgttgacgtctactccgcgtaccgctccttcgaatatcccttgacgcgtctgaagatgatggctgccacagccaaaacaatcaatacgattgaaatcacctgagcgatgcgaagtgaatcagtcagcattaagctgtcagtccgcattccttcaataaagtatcttccgattgaataccaaatgatatagatcaagaacatctcgcctctacgcaaattcactctgcgcagcagcagtaaaacaatgacgccgacaaagctccatagtgattcatataaaaaagtaggatgataatattgcccattgatatacatttgattgatgataaattcaggcaggtgcaggttttctaaaaaggctctgctgacagcctcgccgtgcgcttcctgattcatgaagttcccccagcgcccgatcgcctggccgagcaaaatgctgggcgcggcaatgtccgcaagcttccagaacgaaagttttttcactctcgaaaacacataacccgttaaaatggcgccgattaatccgccatgaatggcaatgccgcccttccaaatcttaatgatttctcccggatgtgccgcataatagtcccattcaaaggcaacgtaataaattcgcgcgcaaataatcgcaattggaatggcaaacaggacaagatcaataaacgtatctttctgcagcccccgtttttcactttccctcatcgcaatccacagcccgagcaaagcaccgagaccgataatgattccgtaccaatggacggctaacggccccagctgaaatgctatcggattgagtggttctatcgcttcattcatttaacgccaactcctattcttcttgttcaccgtcttcaatgacgtccgccagcttgttggtaaattgttcagcggcattcagccccatccgcttcaatctgaagttcattgctgccacttcgatgatgactgcaagatttcggcctgggcggacgggaatcgtcagttttgtaatttctgtatcaatgattttcatggtctcttcctcaagtccgagccggtcgtattgcttgccctgctcccagagttcaagattcatgacaatcgtgattcgtttattgcttctgaccgcgccagcgccaaatagcgtcatcacattgataatgccaaggcccctgatctcaagaaggtgctcaattaattccggagcgtttcccacaagagtatcctgatcctcctgccgtatttcaacgcaatcatcggcaacaaggcgatgccctcttttcacaagctccagcgctgtttcgctttttccgacgccgctctttcctgtgatcagcacgccgacaccatatatatcgactagaacgccatgaattgctgtggtaggcgccagcctgctctcaaggaagttggttaaacggcttgacagtcttgtcgttttcagcggcgatctgaggacaggcaccccatttttctcggaggcgtcaatcagctcctgcgggatgggcatatctctagaaagaataatagctggtgttacatcagtgcacagagaatccattcgctgttttttctcctcttcaggaagctgttcaaagaaagaaagctctgtttttccgagaagctgcacgcgctctctcgggtaatatgtaaaatatccggcaatttcaatgcctggtcttgataggtcactcattgtaatcgggcggttaattccttcttctccgctgattaattccaaattgaactgttccattacgtcttttgtgcgaacctttgccacgatatgttcctcctgttccgggctgccccgagcttgctcacaatactttcattttatcactttcaggcttgaacctaaaacagattttataaaaggcgggaaaacacctcagctggtctagatcactagtctgaaaaagagtaaaataaaggtattcaaattccagaaaggcggatcatctatggcagagagtcttcttatcaaagacattgcgatcgtgacagaaaatgaagtaatcaaaaacggctatgtcggaatcaatgacggaaaaatcagcacagtctcaacagaacggcccaaggagtcatattcaaaagaaattcaagcacctgcgaattccgttttgcttcccggcatgattgacattcatatccacggcggctatggtgcagatacgatggatgcaagcttttctgcgctcgacatcatgtcgtcaagactgcccgaagaaggcacgacgagctttttagccacaacgattacccaagagcatgggaacatttctcaagctttggtgaacgcaagagagtggaaagcggctgaagagtcctctttattaggtgcagaactgctcggcattcatttagagggcccctttgtttcgcttaaaagagccggagcgcagccaaaggagtggattaggccttcggatgttgcgcttttcaaaaagtggcagcaggaggcaggcggactgatcaaaattgttacacttgcgccggaggaggatcagcattttgaactgatccgccatttgaaagacgaatcgattatcgcatccatggggcacacggatgccgattccgcattgctgtcggatgccgcaaaagcaggggcgagccatatgacccatctgtacaacgcgatgagcccgtttcatcaccgagagcccggagtgatcggaacggcgctggcccatgatgggtttgtgacagagcttatcgccgatagcattcactcccaccctttagctgcaaagcttgcttttttggcgaaaggcagcagcaagctcattttaattaccgattccatgagggcaaaaggcctgaaagacggcgtatatgagttcggcggccaaagtgtgacggtaagaggacgaacagctcttctttcagacggaacccttgccggttcgatcctcaaaatgaacgaaggcgcacggcatatgcgtgagtttacaaattgctcttggacggatatagctaatataacttctgcaaacgcggccaaacagctgggcatctttgaccgaaaaggcagtgtgactgtgggaaaagatgcagatttggtgattgtcagcagtgattgcgaggtgattctcaccatttgccgcggaaacattgcatttatatccaaggaggctgaccagatatgaaagtaatggaatgtcaaacgtatgaagagctaagccaaaaagcagccagaataacggcagatacaatcaaagaaaaacctgatgccgttctcgggttagcgacgggcggcacaccggaaggcacttatcgcgagctgatccgcctgcaccaaactgagaatctctcatttcaaaacgtcactacagttaatttggatgagtacgccagactttcaagcaatgacccgaacagctatcacttctatatgaatgaccgtttatttcagcatatcgacagcaagcctagccggcattttattccgaatggaaatgcagacgatttggaagccgaatgcagacggtatgaacagctagtcgagtccctcggcggcactgacattcagcttctcggcatcggccgaaacggacacatcggctttaacgaaccgggaacctctttcaagtcgcgaactcatgttgtgacattaaatgagcaaacccgccaagcgaatgccagatattttccttccatagacagcgttccgaaaaaagcactgacaatgggaattcgaacgattctctcaagcaaacgcattctgctgctcatttctggaaaaagcaaagcggaagctgttcgtaagctgttagaaggaaacataagcgaagattttcccgcatctgctttgcacctgcattccgatgttacggttttgattgatcgtgaagccgagtcattaagaccttgaaaggaacatgctgacttatgaatatcaataaacaatcgcctattccgatttactatcagattatggagcaattaaaaacccaaattaagaacggagagctgcagccggatatgcctcttccttccgagcgcgaatatgccgaacaattcgggatcagccggatgacagttcgccaggcgctttctaatttagttaatgaaggcttgctctatcgcctgaaaggacggggcacctttgtcagcaagccaaaaatggaacaagcacttcaagggctgacaagctttaccgaggatatgaaaagccgcgggatgacaccgggcagcaggctcattgattatcagcttattgattcaactgaggagctcgcggctatattaggctgcgggcacccctcctctatccataaaatcactcgggtgcggctggcaaatgatattccaatggcgattgagtcctcacatattccgtttgagcttgcgggtgaattgaacgaatcgcattttcagtcgtcgatctatgatcatattgaaaggtacaacagcataccgatttcccgtgcaaaacaggagcttgagccaagcgctgccaccacggaagaagcgaacattcttggtattcaaaagggagcgccggtcctattaatcaaacgaacaacatatctgcagaacggaacttcttttgagcatgcaaaatctgtatacagaggcgaccgttatacatttgtccactatatggatcgtctttcataaaaaaaaagcctccaaccctttttaaggattggagacatggcgaaaatcaaactggtctggtgctggacgatatgtctcttttttcgtcttgaacttccagatcggtgatttcgttttgccattaaaactgtcttccactataatgtaccaataataaacagactgcggttcaagatgatcccagcggaattcagctgtatccccgctcttcacttgctcccgttttccgagctcttcattggtatatacgttacattcaaaataatcggtttccacctttttgattcttggcttcaaatcaagcgaaagggaaaattcatccttgttgccataggtatccgtatcatagtaattcttatcctttacatacggagaatacgtcgatacgtgcaccatgtcattggcctggtcaaattgaagcaaacgcaaatacccttgaccgccttctggcccgccctgataatcggccagcatttgatgcacaagacgatccggcttcccatcaccatcatcatccagctcatctgtttttctcatcgcactatgataatgcccgctcaataccatcacgacattcgggttcggctttacgatttctttgaatattttctctccgattgggcttctgtttccgctgaccagcaaatactcatgaaaagctaaaatggccatccggtcagggtgtttcttcagcacctgattcatccacgcgatgtcttcatccgtaatgccccatcccatgtacagcatgatataatcattgccgttgctagaaatcaggtcataatgtccgcggttatttttataggaaccgccataatgcaattttttatcaaaacgatcgctgccaaaatatttgccaaacaccctgtaggagccgtccttatgtccgacatcgtgattgccggccagcactccgtaaggaattccgctcttatccagaacggacattgaccgatcagcgtttttccactgtctgatatcggcggaatcatctacaatatcacccgtgtggaacacatatttgatattgagctgcttttgattatcttttatccattcggtctgtttatcaaaaatatgcggatagctttcggcgtaatactgtgtatcagacatccagacaaatgtgtacatatccttcgcaggaggaatttcatcctgtacaatcacattcattttcgactcccgtacaaaatcggcggcaatcacagacgctttcagcgtaaacggtttgtcatccttcgcgacgaagctgtcaacaggctgccattcgtttgtccgataattccaagcatacatcgtcacctttctccccggcaaagaactgcccttccagaccgcttctgccagatcattctcatcaattgatggatcaaccgtcacttcaaagcgatgataagggaaaagctctttgttttctgtcgatactgtttttccatcagcagctgatacccgctccaattctttattcgtaaatggggtctccctttccggcacaaagcttttcggcggttcagtcagtgacgcgtgcttaaatattttcacatgattgcgcgctgtatattgaaatcccctataaaaaccaacatccatggcgtcattcgtcggatctttcacccgtacagaaagcttggccttatgcgtgtcggcttcgctgtctataacctccggctggtccggatgctctcgttcggttttaaatatcctctcaatcactgttttattgcccgcgagatccgttgctgtcacttttagagaatgttttcccggcaaaaggtcagaagatgatgtatgatatgggagtgtaatgctttctccatctaaagacgcttccgcttcctcaattttgctccatttatcatacatatccgcctgcaggataaggtttcctttatacgtttgcccctcggtgatattcggctcaatgtgaggtcctgaattatctacccgtacaaccaggctgacattttccttgccgtcgcttgcttgaatatggtgagcgccttcagaaagctttgatgtatcccactccagcagctgtgatgtaaatagtccgtcaggcagattgaactgaaattgccagcttttattcgagcgctgattatcgccaataaagagttccttctcaggagacaccctctgatctctgatcaccgttccatccgataacaccaatcgggcgtttttgactaagaagtcatcacggttttcagccgtatcaaacggagacaccttcgaacctgaacgtatcgtaatacgctgcagctgcttccctttccgaagcagtgtctctggcaatggaacagaataggtgcggtatttatttgttgtatcatcgaacaccttcagcactttgccttccatcgttaccgcgtttttaaaataaaggttcgttttcctcgtatcgaatgcaaaatatacttctttttccatcgcgggctctgtcacttgttttttcccgtcaatccacagcttaatgctgtcagctcgcccttctgtcgtggctttgagaaattgagttcccgacagcgtgtctctgttttcaatattcatccgcagaccgtgcgccttgcttgtttgtttaatatcaatcattttgaccggcgttctcgcttcattgatcccgtccccggccgccacataatactctagctgatccttcccgatcaattcaggcgaatacacaatataatggaagagattatcgttgcggtctttttcagcaagaattcgcttaaacggtttgttctcatccgtccggtagtaaaaggccgctgttttcactaggcttcggtcccgtatgtcagcccgcagctcaatgctttcagcagggcggacaggcttgcggtcagtccaatcctcaatgaccggcttttctttatcgagcttgattttccgtttctgctcgggcacctgtgcctgtaatacggttccgggagacggattcttttctccgattgaaatgttcagaagttctgcggttccgttcaacggatacttataaagcactgatgacagccggcgcagcgcatgtttccgataatgcgcaaccgaaatgtcctttcctgtattcgttgatatcacaacggcccgcggcctcgtattggccataccctctgtctcgtctatcaccgcgagattttttccttccgttaattgtgtctggtaatatcgattgaaatcctccgccgtcaattctggatgcccggcaggcttcagccagacgacaaacgtttcgccggatggtatcaagatcctttcatcaggtctccaaatcagatcggagtcaggcccttcttttgggtagcggtaacggatatggtagtctttaaaatcaatcgttctgtcagtcgtattaaaaatctcaataaattcataaccgtctgcgcgtcctatattcttcgtatcaaccgccagctctgtgatcagaagctccggaatatgggcaaggtcagcctggtatccttcaagcttcagtttcttcgtctccgactcaacccgctgcttcccattcgacatcacaatgtaatactcaagctcgctgttccaaatcaaacgtttcggaatttgtgccaaaaacttgcggaccgctccgggggtcgggtccatcggcaccattttgtagcccagctcattactttgtttataaaaaagaaaggcggaaaatgcttgatacgaattatcgcgaacttgagcctcaatcattagattgcttctcatttcagctttcacatcaatttgaggaggattttcaagcaagggtatgtaatgaggcgtctgaaatggttcctgctgaacaacaggaaaagctttcgattcatgatggccgccagacaaaacggaaagaaaagacaataatatagaagcaataaccgtgtatttcctcatcaaagcacctcccttttcatgtattttgcgtctgaacagggaagcttatgagttcatttttgtgcataaagaacaaaaaaacgtctgtctcttgaaaattccactattacctagtaaactaaggatagttaaccagttaacaattaaatcagagaggcaaattgatggacaacagcattcatgatgaattatttcaagctatacaacaattcgcattaaaaagggataaacgcgtctggcaaaaggtgcagataccatccattggcatatcctcacaacatcacgatcacctcaaaaaagactggactttgacccagcttcacattgtttcctgcatacataccagccaaaatgtgaacaacagcttcttagcatcccgtttacacatctcaaaagccgctgtttcaaaagcggttcatgctttgttgaaacacaatatcattacagtgacaaaaaagcctggcaacaaaaaagaaattttttatacgctaactgatagcggcaaagaactggcggggttacatgaacggcttcatcaaaaagcaaaggagcaatacaaacagctcttcaatgaattttcaattgatgagttgaaaacagtgactgcgtttattaacttgtggatcaagcatatgtaaaaaagcctcacccgcacgggagagacctttccatattattaagccctgtcaaatacaatatgaagtgagacgggtccgcgtgtatacagaccggactcagcataacaaaaatcttcctctaatctgatattccgcatcttatccagcacaatattagctacaatttcgatttcggttttggcaaaagctgctcctacacagttatgaatgccggatccgaaagcgagatgccgggcggcgccgctaaaagcgctcttgatgccaagatcttcccgatgaatattaaacacgtcaggctgttcaaatgcttcagggtcccggttagccgcaccgatcatacaaaaaacaatcgtatcttttttgatttccataccgccgaccactgtatcttgggacagctgccgcggaatcagctgaaccggcggtttataacgcaatgtctccgcaatggctctcggaactaacgaacggtcagccaaaacatcattcatctgctcaggattgttgagcaaatggtagatcatcagtgccagcgtcttatcagccggttccgttgcggctaacagcacattaagaatcagtgcgagtatatccttgtccgacatcgccatgccttcatattcagaagtacataggatggaaattaaatctgatcccggattgacgcgacgttcttcaatgaccggcatcaagtattgggaaagctgttcgctgcaccataacgaatgtgcccgcgcttcaggagattgagagatactcgtgataaaatcggcaactccgctatgccactcagagattttttcatggtctcttttatccagcccgagcatgtccatcgtgacgcacaccgcaaacgtctttccaaaatcattgacgagatcaattttccctctttcaagataaggcgctaacaagttttctgcattttgtttaatcaatggagacagatgatccagtgcgtcaccgatgaagcttctcactacaattcttcttttggcagagtgttcttttccatgcatttgggccagcacagggcctcgcattactggttcggcacgctcaacaagtgatttcgtcgtgaaaatatccggatgctgaaggatatagcggacatcatgatagcggctgataaaataactgtctatcgactcttcataatgaaccggatcttcctcccgcagttgtgaaaaataagcatatggattgttttgaaattgatcagaaagcacactaaacaatttaatcgattggctcatgttttactccccctatcatccttcacatgtgatccgtttctcagaaagcatctgcgccatttcctgtacaatgagatacccgtgattcgaccgcatacaaatagaaaattcatggttactgatcttctcaccgagcttccacggacgatgataagcaaggagcgtctcttccacctctaaaatatccggagctccgataaaaaacggcagctcagctatgacatattccacagccaaattcagcatatcctcactgacttcttccatcatcaaactgacgccccgtgcacgcccgattatcgcttcacgagacatgtccaaacaagcatgtcgaaaatgaggctgctcaaaaaaagcatgttcaacttcttgtctcaacagctggtaggctttgttatccataaaatcagaaaatgtatgaatcgccttcggatccccgccatgagccacaagggctctttctgcaaatctcctgtttcgtgatacctctttccttacttttcgttcagcctttcctctcggagttccaagcgcttctagaagattagccgcctcatgccctgcaagtaaaactgaaacgcttttaaattgagctttcgcccatccaattaatctgtaaatataatcctctgaaaacctgctgttaaatgggctgatccccaccaaaacatgcctgcgccgttcaaatatttctctgcagttttctgttaatgcctcagcaataaaatgcacagaccttctttccgttaccattccggtcatctcattcacccctaaaacttatcccgctttaagtcatcaccctcaaatacaagatggaatagctagaacaactgaacaagacgaatggcaggcagcacttaaagtttccaaatgttttttaaaattttaattactatttccatttcacatatcatgataaatgtttactagtaaacattagtcattttatcccttttccttccaaacgtcaatatgatctgtgcccaaatatttgaaaataaatgtaaacatcacattttccacacactttttacacgcatattcagcatgacagatcaacaaatagtctaaacaccaacaattgacaacgaaaacaagaaaagataaaatgaaattgttcaccagtaaacaatttgttttattgtttcatcgtaaactattattactaagaaagaaggtagcctatgtctgatttgacaaaacagatgatatacgacatatacgtgagactgctgcaccttaatgaacaaaaagcgaatacttcacttcagcaattttttaaggaagccgcagaagaggatgtgattgatatccctaaaaacatgacaagcatacatgtcattgactgtatcggccaacatgaacccattaataatgccggaattgccagaaaaatgaacttatcgaaagcgaatgtaacgaaaatcagcacaaaactgatcaaggaagaattcattaacagctatcagctgacagataacaaaaaagaagtttattttaaattaacccgtaaaggcagacggattttcgacttacatgagaaactgcataaaaaaaaggagctggctttttaccaattcctcgattcattttcacaagaagaacaaaaggctgtattgaagtttctagagcagttgacgtcaacacttgaagcagaacaaaccgatgggactccggacaaacctgtaaagtaaacaaaaaggcggtgtacactttggctcatacaaaatcaaaggcagtattgatcttatacactgtttgcttcagtgcattttttgcatctttaagccagaacatttattcacctattcttccgatcattaaagaatcattccatgtttccacagctatggtgaacctgtcagtctcagtttttatgattgtgacagcaataatgcaaattatattaggagcgatcattgattttaaaggcgctcggatcgtcttgattaccggtattctggcaacggcagcagccagcatcggctgtgcggtgactactgactttactttgtttctgatattcagaatgatacaggcagccggttccgcagcactgcctcttattgctgccacaacgatcggacagctgtttacaggcaatgaacgcgggagtgcaatgggaacgtatcaaatgctcctgtctgtcgcaccggctattgccccagttctaggaggattcataggcggagcagccggatacgaagggattttttggatacttgcggccatctctatcgttttgctggtgacaaacagcatcacctttcctaaagattctccaactgaatctatgcagcaagccaaaggcaatgtgttcgctcattataaatcaatatttacaaatcgaacagggaacgtcattttgactttaagttttgttctctttttcatttattttgcagtaattgtctacctcccaatattgctgacagagcattaccatatagatgtgggtatagcaggactgttatatttgccgctggcgctgagcacgattgcaggtacgtttctgtttaaaagaatacaggcaaaaatcgggctgcacaccttgtttatcggaagcaatgtgattgccgcctgcagcatcattttatttgctgttacacattccgtttctctcgttctcatggctctgacgctggcactgtttggcatctcgatgggggttattcctcccttgtactctacaatgattactaatgaatttgagcacaacagagggagtgcaatcggaatgtttaactttatccgatatacaggcatggcagcaggtccgatggtatctgcctacttgctcacaatgatgccgtctgccatgtcctttagcctcctaggccttggatttgccgcattgagcttttgccttcttccgccaatgttttcgccgcagaagcgcacgaaacaaaaaaagcaccacatgtaaaaaagctgcctttgcgggcagctttttttatttttttctaagcggctctaaaatgcctttttgaatcagcaaatggaagaccgacaggataacggatgcccatatcgctgtgccgaagccgtcgatttgaaagctgtcacccataatggacgcggtcatcataagcgtgatggcgttaatcacaaacaagaagagtccaagcgtcaccatggtgaccggcagtgtaaatataattaaaagcggtttaatcagcacgtttaagatcgataaaatgaggctggcgataatcgctgccccaatgctgctgatatggatggagtcaatatatccatcaatgacgattaataacaatgcattgactaaaatgctgactgcccattttaccatgtcatttcatatccctttctgacgggacgataaaaatccaaatgatataaatgagcaaaaccggcaagacacttgtcataatggctaagatgacagttatgactctgaggagtgatgcgtcccaattgaaatattccgcgagacctccgataacaccggcgattttcttatttttttctgagcgataaagcttattcattcgatcacctctgtgagtactttagtttgatggcgcctgttagtgattctgagaagacggtgatgttttgatcatgtgcctgatttgaagtgaacatcatttctttttgaatcgtatcatttttttccttcagcatctctacatccattaattcatgggacagcgtaccaagattgcttttcagctctgccttcactgcgagatcgtccggaattgcaagctctacatttccagtcgttgtttttgcataaatggagcggcagtctgattctgttacgttaatcgcaatatttccgttaaagctttgaacgtcaatggattcgcttttccctcggagatcgatcaatccgttaatggtttccgcttctatcgtaccgcagctgtggcttgcgagcttaatttgcccgttggccgtttcagctatggctttttcggctgttaaatacgagaacgacagcacgccgtttgtcgttttcgctgagaactcttttacatgtaaatgttcccctctgaccggaccgttaaacagcttcacccgaatcttatcatactccttctgaggaatatacaaagtgacattcgttttcatcgtctttttctcagtacggataaaaaacttattacctttgatttcacattcaatatgctgaagaaatgcgtgtctcgccgcatcctggttgtcagcgcgatataccttcgcctggcattccgctctgatatcgtcatcttcccaagggacgatatttacgctgccattggcaatttgcagctcaacactggaaaagtcagtatctttaaattgaaaaatgtgctgaacatcatacgcatggccaaagtttaaatcaaggtcaacttccttgacctttttcacagcagaatcaatccagtcaaacagcttggctcctaaagacggtttaccgctttctttttttgccgttgtaaatggctcttcctcgtcatgaacgtgaactgagagcgctgtgattttctcttctttttccttgtagtcgctgtcaagcttttcaatcagtgtcaaagcttcttgtgctgtaagctttccttcctcaacaagcttaaggattcgttccttttcttgcttcattacgatctcctccccattgtctacttatgctgcacgcaggaccttaatgccctgaatcacattccaaatgataatgccaatgacaactaagaaataaataaccgctcccccgatgattacaaatacaggaagcaagctgtctccatcaatcgcaacggctccgccaagtaaagcaataaaaaggaacagccagccgacaaacggaacaatgtgagaaataagagagcgtatcgcatggcgttttgtttctttctcatttacaacaaaatatgcgacaatcggcacaatgattggcgcaatgaacacactgaaataacaaagtgatgcaataatagcttgattacggttcaattcattccacactcctattgtgaattgtccatgacaaaagatcagggacgttttacttatttatacgtttaaaatctcttcaggtttcaaattcattctttagacatgctccgatttacggaaattggattttaaaaagttttagaagtagaatcttccggctataccgattacaatatgtaaaaagcttacggcaaccaaggaggctggacaagcaatggagaaagatcccagtgactatacagtaacacaagaatcagtgttaaagctgattcaggaacaaaaaagaatgaatcgtgaaatgatcaccgagcttgagcagattcacggacccttcccgatctctcacgatatccaatatataaaagtgctgctcgacagcagcaacacacatattgttcaagatttaatgagtgtaagtaagcagctgtataagaagactttgtaattgcggaaaacatatcattcattataactgaaacaaagctaaaggttagatgacaatatcttgccttttttgttttgaaaaaacaagtgattccctggctgtcacaaaatgattgtaacaaaaaaaagcctgccggcacatccagttaatggactctgtcggcaagctgtaactatcagaaagagatagccgttcaaaattaacgtaacaattgaagcacgttttgcggctgttggtttgcttgagcaagcatcgcttgagaagcttgagaaagaatgttgttctttgtgaaatcgctcatttctttcgccatgtcaacgtcacggatgcgagactcagcagctgttaagttttcagaagaagcaccaaggttgttgattgtgtgctctagacggttttgtaccgcaccaagtttagcacgttggtttgaaacacttgtaattgcactatcgattttaacaatctcagtgtcaaaactaaaatcatctgctgaaacatcgataccttttactcctaaagttgttgcatccatgttaccaattgtaacattaatattttggccagcatttgcaccaatttggaatgtaaatcctgctgtttcactaccgtctaaaagtttttttccgttaaattcagtacgttgagaaattccatcgatctcttcagttaaagcatccatttcatctttaattgcagttaaatcttcagtttgctgtgtacctgtgtttcctgcttgaacagtaagttcacgcatacgttgaaggattgcatgggtttcagtcaatgcaccctcagctgtttggataagagaaattccgtcttgagagtttttagaagccatttcaagacctctgatttgtcctctcattttttcagagatcgctagacccgcagcgtcatctcccgcacggttgatgcgaagacctgaagaaagtttctccatgttttttgagctcgcactgttgtttgaagacaaacggtttagtgtgttaagcgctgcaatattgtggttgattctcatgtgaaaaatacctccatgtgtatatgtttttgaaatcaaagacttccttttctttgatttctggcgtatcagattccaataaagcttctaacctatgtagattcagttattgcttaaggatgcctttaagccccttaatagggtttgtctgcttaatttggaaatcatcatccgcctttcaattcatatatcgacagccatttgtaaatgtttaggcgttttcccaaagaaattataccaaagacgaatctaaacctattatgccgtaaagaaaaagcttgcctgctaagcccaaggatggacttgctgacaagctgtcccctcttaacagaggtttttttaagatgtagctgtttcttttgctttcaagagcgatttcatgcgtgttttgtcacgttcgataacaggcttcaaataacggcctgtatacgattcttccacttcagtgatttcctcaggcgttcctgacgcgacaatggttccgcccccggctccgccttccggtcccaaatccacaatgtaatcggccgtcttaatgatatcaaggttgtgctcaataaccagtacagtgtctccgttgtctaccaaccgttgcagcacgacaagaagcctggcgatatcgtcgacatgcaaacctgtcgtcggctcatctaaaatgtagagcgtgcgtccggttgagcgtttgtgcagctctgacgcgagcttcacgcgctgcgcttctccgcctgacaaggtcgtcgccggctggccgagcgtaatataacctaaaccaacatcataaagggtttggagcttgcgtttgattttcgggatattttcaaagaaagaaagagcatcttcaaccgtcatatcaagcacatcagagatgctttttcctttgtacgtcacttcaagcgtttcacggttatagcgtttgccgtgacacacctcgcatggaacgtatacgtcaggaaggaagtgcatttcaattttaataatcccgtctccgcggcaggcttcacatcgtccgcccttcacgttgaagctgaaacggccttttttatagccgcggaccttcgcttcatttgtctgcgcgaatacatcacgaatgtcatcaaatacaccggtgtatgtcgcagggttggatctcggcgttcttccgattggcgcctggtcaatgtcaatgactttatctaaatgatccaaacctttaatctctttatggctgccgggcttcgctttcgctttatgaagcttttgcgccagcgccttatgcaaaatttcattaacgagtgtactctttcctgaaccggaaacacctgtaactgctgtaaacgtcccaagcgggaacttggcattcacttttttcaggttgttttctgaagcacctttaatttcaatgtaacgtccgtccggctttcttctttcaggaggtaatgggataaactttttccctgataaatagctgcccgttaatgagtttggatcttccatcacttcttccggtgtacccgcagatatcacctgtccgccgtgaatgccggctcccggtccaatatctattaaataatctgctgccatcatcgtgtcctcatcatgttcgacaacaatcagcgtgttcccgagttctctcatatttttcagagcgctgatcaagcggtcgttatcacgctgatgcagaccgatagacggctcatctaaaatataaagcacaccggataagcgcgagccaatttgagtcgccagcctgatgcgctgcgcctctcccccggacaatgtacccgctgccctgctcaatgtcaggtaatcgaggccgactttgtccagaaagcttaagcgctccacaatttcgcgcaaaatcaaattggcgatctgcatatccttctcagaaagggtaaggtctttaaagaaggcaagtgcgtcggcgacagacagctcggtaatttttccaatgtggcggccgtcaatcagtacggcaagcgcctctttctttaaccgatagcctttgcacgtcggacaagatttctgagacatatactgctccatttgctcacggatgaaatcagagcctgtctccttatagcgtctttcaatgttgcgcaatacgccttcaaattgaatttcaccttcgcgtatttgtccaaaatcattttcatatcggaaataaatcaggtcatccccgctgccgtacagcactttatccagttgatgcttcggcaaatctttgaccggcacatccatatcaatcccgtagtgggtgcagactgcctcaagcagctgaggataatattgtgagctgatcggtgtccaaggggcgaccgcattctccttcaatgacaaatcttgattggggatgacaagatcggcatccacttcaagcttcattccgagaccgtcacacgtcggacacgccccgaacggactgttaaacgaaaacagacgcggctcaagttcaccaattgaaaatccgcagtgcggacaggcataatgctcgctgaacatcagctcttcctcaccgatgacatcgatcataacccgtccttcacctaaacgaagcgccgtttccaatgaatctgacagccgggctgccacgccttctttcacgacaatccggtcaatgactacctcaatggaatgcttcttgttcttttctaattcgatatcgtcggaaagctcagccatctcgccgtcaattctgactctgacatagccttgtttcctaatctgttcaagcactttgacatgagcgccttttcggcccgagacaatcggcgccagcacctgaagcttcgttcgttccgggtattccagaattctgtccaccatttgctcgatggtctgggatgtaatctcaattccgtgttccggacaatgaggcttccctactctcgcatataaaagacgcagataatcataaatctcagttaccgtaccgacagtagacctcggattgcggctcgttgttttctgatcaatgctgatggcgggagagagccctcaattgcatccacatcaggcttatccatttgccctaaaaactggcgggcataagcagacagcgactcgacataccgtctctgtccttcagcatatatcgtgtcaaaggcaagggaggatttacctgatccggacaaacccgtgacaacgacaagctgatctctcggaatcgttacatctatatttttcaggttatgcgccctggctcccttcacctctatccgatccatagccatttgttcatcatccttccgcttttagctctaaaagtaaatcgcgaagctccgcggctctctcaaagtcaagcgccttggcggcttccttcatttcatgctccatctgttcaacgactttctggcgttctttcttcgtcattttcgacagcttcggcgcggcttttgttttgtattccgctttatcctcagctgctactgtggcacgaatgacatcgcgaatttctttatttatcgttttcggcgtaatgccgtgctcttcgttaaaccgctcctgctgctcgcggcggcgttttgtttcattaatcgcaatttccatagacttcgttattttatcggcgtacataatgacgcggccttccgcatttctcgctgcccgtccgatggtctggatcagcgaccgctctgaacgaaggaaaccttccttatccgcatccaaaatcgcaacaagggatacttcgggaatgtccaaaccttccctcagcaggttgatgccgacaagcacatcgtacttgccaaggcgcaggtcgcggataatttcaatccgttcaagcgtcttgatctcagaatgcagatagtttactttaatgccgatttcttttaaataatcggtcagatcctctgacatcttcttcgtcaaagttgtcacaagcacccgttcattccgctcgattctagcttgaatttcgccgatcaagtcgtcaatctgaccttcgattggacggacgtcaataagcgggtcaagaagccccgtcggacgaatgatctgttcgaccatttcatctgtatgttcaatctcgtacggccctggtgttgctgatacatacacgatattgtgcatatgcttttcaaattcctcaaaacgaagcggacggttatcaagcgctgatggaagccggaagccgtgatccacgagcacctgtttccgcgcctggtctccgttaaacatgccgcgcacctgaggaattgtcacatgcgactcatccaccacgatcataaaatcgtctgggaaataatcaagaagcgtatacggcgttgaacctggaggccgcagcgtcaaatgtcttgaatagttctcgatgccggagcagaaacccatttcacgcatcatttcaagatcatatcttgtccgctgctctaaacgctgcgcttcaaggagctttccgttttcatgcatgaccttcagctgctcctcaagctccttctcgatattttgaatcgccttctccattttctcggcccgcgttacgaagtgggatgccgggaaaatcgcaacatgatctcggtcgccgagaatttctcctgtcagcgcatccacttcccgaatccgttcgatttcgtcaccgaaaaattcaactctgatacaatgctcatcacgggatgccggaaagatttccactacatccccgcgcacacgaaatgtaccgcgctgaaagtcgatatcgttgcgggcatattggatgtctacaagttttctgagcagctcgttgcgctcaatttccatttcagtccgcagtgacacgaccatttcccggtattcctcaggcgaaccgaggccgtatatacaagacacactcgcaataataatgacatctctgcgctcaaacaaagctgatgtggcggagtgtctcagtttatcaatttcatcattaatactagcgtctttctctataaatgtatccgtttgaggcacatacgcctccggctgataataatcatagtagctgacaaaatactcgacagcattgttcggaaaaaattccttgaactcactgtaaagctgtccagcaagggttttgttatgggcaatcacgagagtcggcttattgacttctttaatcaaattagacaccgtaaatgttttcccagttcctgtcgcacccagcagagtctgatgcttcttgccctcctgaattccttttacaagcttttcaatggctttcggctgatctccttggggctgatatttcgagactaactcaaagcgatctttcacaaaaataagcctccgtttctttaacgaaatcttcctatagatatagtaacacaatggaaagcaaaatcactaaaaatacgaactaaagttcggtggttttttatttccagctgtttttgtgtataaaaaacctgcttttaaaacgtaaaagcaggtattcagtctttatattcattatgtccgatttattcttcttttttctctgcagcttttttggccatatacagtccgccagccacaagagacacaacatccaatcctacaataaaatacgtttctgtatagccttttaaataagaggcaaacagcaatgcagctgttaaagcgatcgccacataatgattaaaggtgactctagtaaatagaacaacaagcataaaagggaaaaacaatgcaaaaacggcttttgtaatcaacaaaaaccctcctcagggattcttcatctgatctgattatagtaaaaaatgaagaatcggacaatcgtgcattcgctccctctactacaccataccccttttcagccaaaatcaatcactatatttgcattttggtgccggtcaaaacttattccatggtgccgctgttctaatcagcggcactttttttattacatcatcaagtccgccgccagattccgagaataaaagaaaataggcatacagtaccagtacggccgcatttttcaggataatataaccaacttaactattcattttatttaggactttctgcgtttgacagcattttcctgaaaacctacaattaaatgatagtgtttactatcattttttaaacacaggctccgcaataaaaagactagagagaaaaacaaaatgaatgaagaaaagaggggtttcaaatatgtattctgttttatttcgccaggcagaagagtccagccagctggctggagcaaaaggaatgaatttgattaaattgaccaaacacggtcttcctgttccggacgggtttattattcaaacgaatgcgatcgcacgttttatggaggacaaccagcttcaagagactagtgaaaacgtcgaaggcgggatcatttccggaacattttcggatgagctgaaagatgagctgactagttccttttataagcttagagaatcatatcgatccgtagccgtgcgttcttcgtctgcctcggaagatttagaaggcgcctcattcgcgggtcaatatgaaacctacttaaatatcaaaacagaggaagaatttctggctaaagtgaaagaatgctgggcttcatttttttctgggcgggtcagcagctataagaaaaaaatgaacaatcaaatcgcagagccgttaatgggtatagtcgttcaggggctgatcgattcagaaatgtcaggtgttatcttcagccgcaatcctgttacccatgatgatagagagcttttaatcagcgccagctacgggttgggtgaagctgttgtttcaggaagtgttaccccagacacgttcattgttaaaaaatcttcgtttgagattcaaaaagaaataggtgcaaaggaaatctacatggagtctgcggcagaaggaattgctgaaaaagaaacgagtgaagacatgcgcagccgtttttgccttacagatgaacaagtgattgaattggctgaaatcacaaaaaaaaccgaagacctgtacggatatcctgtcgatatagaatttggaattgctgatcatcaaatataccttctgcaagctcgtccgattacaaccattgatcaggacaaaaaggcggcagaagaaaaacgcagcttcatgattaccgacactgatatgaatgatttctggcttaacatggagtctaatattgaaggtccggtgagtccgttattttcatccttcatcgtgcctgcgttggaatatggcttgaagaagagcatgcaaaagtttccgattggtgtagttgttgatgaagtaaaactttatcgcggacatatttattccaaaaaccaaggagggcagcagcctccttctgaagactgcggcaaagagcttttcccgattttatcggagcatatgtatgacatcattaatcacacatacctccctttttaccggacactggaccagctcgcacaaactgagcataccgcagaaagcgcactggatgcttttcaaaaactaaaggccttttatctcacggcttatgaagagcacttcaatatcgttttcccgcaaatccttttaacaaacaaactgcaagcgatgtatcaggacattcaaggagagtccgaaaacgctcatttttacgagatgctgacaggaaaaatgaacaaatcactggaaacggaccgttgcttatggctattttctgtggaagttcaggagaacccgaaccttctggccatttttgaaaacaacaagcctgaacaactccaggagaaattggaacaaacagatgagggaagacacttcctgaagaacgtccatgaattcttgcaagaatacggatggagatctgttaaaagtcatgatctgattgaacaaatctgggtggaaaatccgtatttcgctctggccaatattcaaaattatgtccgtaatggctatcattttgacaatgaatttcagaaaacgaaagaaaaacgagagaaattatacaatgaattcttggaaaacatagaagatcccggtttacgcaccgaatttgaccgctattatcaatggacactgaactctgcaaatataaaagatgatcaccacttttatattgacgccatgctggatgccaaggcgagaatctttctgctgaagataggtgaattgctggcggaaaacggtgtcattcaagatcgtgaggacctttggttcttatatgatgacgaagtggaacaagcgcttcttcaccctgtatccctgcaagaaaaggctgaaaaacgcagacagatttttcatgagtatgagctggcccaagccccggcctacctcggcaccccgacaaaagaacagctcaaagcagctgaagaaattgtcggcgctgtgatagaggatgaaaaaaacacagagaatcatatttttggcattgcggcatcaagcggcattgcgacaggtccggtgaaaatcattcgggacgccaatgaattttctcaattcgcgcctggggacgtactcgtttgcaagatgaccacaccgctatggaccagcctgtttcaagacgccaaagcgataattacagacacaggcggcattttgtctcacgctgcgattattgcccgtgaatacggcattccagccgttctcggcacacgcacggcaaccgaaagactgcgagacggtgacatcatcactgttgacggtagcagcggcaaaatcacagttgtcagccggtcctgatgcgtccccctctttcttatacaagcggggcgggtgtatacttgtcctgccagtatactcgtgaggtgaaacgtattgagaccgacaaacaagagaatccttgatgctgccatgcagctgctcgtcaaaaaaggatatcgcgcaacaactacaaaagaaattgcagaaaaagcaaatgtaagtgaagcgacgattttcaggaactttaaaaacaaacaaggactagttgaggctttgctttctcagcattcttcaaacagaggcagcattttggaacaaacagaaggggatttgtacaaagacctgcttcatatcggaacctgtctcttggaggagctcgaacatagaaaagatatcattaaaatcagctttcgtgaaccggccatgtttcaggatgtcattaaccacgtcactgaatatccccaatctatgaaacagctattggttgattatctcaaaacaatgggtgagaaaggggttattcagacaggaaatgaagcggagcatgccgacgtgttcatgtcgattatcttcggttatttcattcaccgtctccacttaggagaccgggtcatatcaatgccccaggaaaaaatgctggagcacagcacagctctatttgtcaaaggaatttctgctgattaactccttggcataataaaaaggaggatcccaatgagctcaagaaaagaatgggcgctgatcgtctcgctattattgggggccattctggttcccattaactcaacgatgatcgcggtcgcgctctcatctatttcccatacgtataacgagtccatcgcaagcatcacttgggtggttaccgtttatttaatcgtgatggcagtcacacagccgattgcaggaaagctcggtgacatgtacggcaataaaacaatgtacttatggggagtcggcctttttctaatcgcatctctaggctgcgccctttcaccgagtctgctcctgttaattgtctttcgggcattgcaggctgtcggcggggcattgcttacgccaaacagcattgccattatccggcatgttgtttctgaaaaacgcctaccgaaagtgtttggatttttcggactgggtgcgggacttggtgcagcactcgggccttttatcggctctatactgattgacagcttcagctggcattcgattttttgggtcaacatcccgttcctcgccattgctttatttacggcattaacgatgtttcctcaatataaagaaaataaatctgacgcgccgctggatatcatcggctctctcttgcttgcaggcagcatcgtttccattatcctgctgacgaaaaatgaggctccatggggatatgcggtatacagtgtattgatacttctttttgttccgctttttttcagaagagaaatacgtacccagcaccccatcattgactttgcactgtttaaaagctcaacctttacaaatgcgaatctatcagtcttgttaagcaatttgatgatgtatgccgtcttattgattatgccgttatttatgacgaaccaatttgggcttaatacgtctaacagcgggatggcgctttctgtattttcgatcttcatgtcagccagcaactgggtgggcgcgcagctccatcacaaatggggagccaaaaaaatcatttttctttcatttgccatgatggctggtgcgaatctattatttttgctgttaagcagctcgcattctgtcttattcctcatgctctctcttatccttggcgggctcgcttccggagtcggtctgaccagcatgcaggtgtcatcccttgccacagtagaccccggaatgtcaggagtggcatccgggattttctcgaccttccgttatttcggaagcatcatttcatcagccttaattggcctgatttcgggatatcacatcctatttatgattctctttgctgtatccatcatcggcgtttttgtttcattgggcatcaaatctgatgaaacggcacggatagaaaaaaactcagcgtaacgcaaaacagcccggcatcgcatcttcctgcggtgccgggctgccttttatgatccagaagcggctgcttcgtcttcacggtcatcctttacgaagaggatgcccaattcatgatgttctccttcataagaagctcgctggtcaaaacggatttctccattcaaaccgataatttcaagctttacatatgcacggttatgctgaagcgcttcatagaaatcagaaacgttcttaaccggtatgccattgactttcgttatgatttccccgattttcaattccagatcctcagccggcgtattggggataatcccaagcaccattaagccctgatcccttttcgagaaataaaacggagccgcgttatcattcactctttgctttatggacaaaaaaatgcgccctaacaaagcagtacagaccgctgcacccgcaagcggcgtccacagtaagctcgctgcaccgagaactgcgacggcaagaccgagaatacaaacgcgtttcgctgtgatccttatactcgtttcaggcagcgatccctgtaccctttgtccaaatccgacaaagtaaggaatccatagaaaatgaaatgagccgccgggaacagtaaacacgggccaccagctaaggtgcgattctaaaccattgccgggcacgagaaggaacagcggcaaaagccaaacccggtttgccagctgctgtccgatcggcaaaccgcggctgcttacgacaagtgccggtgatgttctcacatgcgcagaacgataagcaaccgctccttcagtgataatcagcaaacctagaaacacagccacagccggccaaacaactgcaaatccttgctgaaatctctccagaaagggctccgcctgatatatttgcagtccaaaacctatcagcatactcacactgacgatatatgcagcagacatccagtttgcgcgaagagtgaacgctgccgctgcagtgataacggcaataatcgcaagtaaaccgagaggaatcgatattccgagtccacctaaaataactgacaaaagaagacctggaatcagtccctttgtatatgtaaatttcagatcatcataaatatctgctattcttgtatgaaaggtttttcgttcccgtttgattcttacatagccgaaagccagggttatgatgataaaaaaccagaaaagcgggtgtaagaagaacaagcccgcgctttttaacagttcaattccccattgaacagacactatctctcaccgcctcaagccaaacatgttactcatattctatcaaatattaaatggcttggatatcctcaggagagtttatctctcttgcgtcatccacagcgtgacattcgatagtgaaaaatcctttaaatagtggtttacatccacatccaataacccgctgattagatgcatcgacctttttatatctgtcagattaattcctaatcgcttatggtttttcattaagtagttaaaataatgtttggcgcattcctcattaatgtcatttactgattcgacattggtgtaattgaccaaatatctgctgaacagcataagaagacttagtgcttttgtagctgaaaatgttacgtcttgtgttctgtcttttaattgttccactaattcataatattttttttcacgcacaatacttgccctcttcaattgtgaacccccattttctttatacagataagcacgggccagtataagcagcagtactggagtgctaacaagcattctcgctaacgttactctttaaatacctgtcgttcagctgccattaacctgattactgttctttttagaaccttcttatattgtatgaagtaaacaaagactaggcaacttgcaaaagtttcattttaaatgcatattaactcgttagaaagtctctctcatatattgatatcgggtaataacagtcctttataaatgtttatttgtgaaaatttttttaatttcttgtcaaaaactcattttttatgtgacttatgatccataatctctttaagtacaaagaaacaggagatggaataccatctcctttaattgacaaataatgatttcaatgctgtttgaagctgcaaatcatttttgtcatctgattttttcttttctatctgctgatttaatgtctctgcagtgcgagtgtcgatcacaccggttttattcagcttgttttgatcctgaaaagccataaccgcttttttcatgtctttgctgaaatagccatcctcacgtcccggatcaaagctgagaccttttaacaatacctgcgcatgcttgacgtcttcattgttcatgtccactttaagcggctctttcagctgtaaaggcccagcggaaaaataatcgggctgcttaatcgcaatggtcggttcaattcctttcttatgaatccaatttccatttggcgtcagccacttgtaaagcgttaatttgatgttgctgccgtcccccattggcacagcctgttgaaccgttccctttccaaaagacgtatcgcctacaacatcataatggccagcttcctttaatgcgccggcaagaatttctgatgcagaggcacttcctttatccgtaatcacattgacagggtacgcttttttatgggtcaatgttgaaaaataacgttttttatccccattgcgttcagcaatctgaatatacggctgatcctttgtaacgaaatgcttaagaatttcttccacactttgaagatatccgcccgggttgccgcgtacatcaatgacaagtccttttatttcttttttctcaagctccctcagcgcttttgcaaaatcctctgcggtgtgctcagaaaaagtagagatggcaatatatccgacagaatgcccctgtacttttttctctgatgcaaaaaccgtttcgagcggaatctcagctctcttgatccggaatgacagctgcttcttcgttccaggccgctgaatcttcattgaaacgctggaccctttttttcctcttatttttaacacagcgtggtttaaatccttgccggccatcgattctccattgatgctgataatttcatcattaggcttcaacccggctttttccgctggcgatttcttgaatggagaaacaataataattttgccgtcttccattccaacctcagccccgatgccttcaaatgaggaatcaagagaatcagaaaattgcttagctgtctgcttgtccatgtaaacagaataaggatcatttagcgtagacagcattccctggatggctccctcgagcagcttttctctatctactttttctacgtactcattcgatattaactcatacgctttttcgattttgtccatagctttatcccgttcagagtcagcttgtgccgtcgcgggaactgctgcagtctggggcttatccatctcaagcaggttgattcccgcatatacaccgacgcctccgaacagcatgctccctgctgctatcacagccattattttttgattcatcctttactcctcctgtatgccagactgtctttaccaaaacctagagatagtatatgtaaaggatggagatttcatgtaatcatagaagaaaaagaaggcaaatgaaaagccgtcccgaaaacggaacggctttttcactttatactcgcaaaaacttgcggatggaagtcagacttccccatactccaattactgcgccgattgcaatcagcactagcgaaacttggaatacaaatggattataaggaagaagagagacaaatgatccttgaacctttggaacgacccatccgatgacgtattggtaagtgctcagcaccagtgcaatcggaatcacagaaccgaatacgcctagcagcaatccttcaaggaaaaacggccagcggataaaccagtttgtcgcgccgacaagcttcatgatttcaatttcttttcttcttgcgaaaattgtaattttaatggtgttggaaattaagaacatcgccgtaaataccaggccgataattaacgcgattccgatgttgcgggaaacgccgaccactttaaacaaacggctgacctcttcttttccataagtgactttataaacatgatccattttttcgatctttttcgccacgttcggcgtatcatgcggatctgtcgttttgacgacaaacgcatcattaagcgggttttcctgatccttcattgtcagggattttccgctgtcaccaaaactgtcaaccagctggtcaagctctttttctttagatgaaaaagtgacactctgaatgcccttcagttccttaatatcgttctgaagcttgtcctgtgccttctgatctgcagtcagatcaaccagcactttgatttcgacttgtttttctgctttcgtggccatgttattcaaattcagcataatcactaaaaacacgccgactaaaatcagcgtaacggttacagcactaatggatgcaaatgtcatccatgtgtttctcccgagagatttaaaactctcacgcaagtggcgcccgagaattttaatcatatgaaccatactcccctcttgactcatcacgcacaatgataccatcttcgattgcaatgacacgtttcttcatggtgtttacgatttctttattatgtgtcgccatcacgactgttgtcccgcggttattaacttcctccagcgtcttcatgacttcccaggacgtatccggatcaaggtttcctgtcggttcatcagcaatgacaacatcagggttgttcacaattgatctggcaatagatacacgctgctgctccccgcctgaaagctggtcaggaaattgtcgcgctttatgcttcagctgcacgagatcaagcacttcaagcacccgtttcttaataacagacggctgttctccaatcacttcaagggcaaatgccacattttcaaaaacagtaagtttcggaagaagcttgaaatcctgaaagacaacgcctattttgcggcgcacgaaaggaatctctttttctttaattgtcgcgagatctttatgattgattaaaatttgtccttttgtcggtttttcttctctgtaaatcattttaataaaagtagatttacccgctccgctcggcccaacaacatacacaaactcaccgggatgaatggtaacagaaatcccattgagcgcttttacgccgttcggataggctttatatacttccttcatctctatcatgaaatcacctaatcttttatatcattttatctatcacacggtcatactcttcgaatgcattcgacaatttatgatccattcatttgtaaaaagatgaaaaatctgaaagttccctttttcaatacacttcattatacgtcaaatttagacataatactattacagtttcttttcattcatatttaaagaataaatattcatttgggttggaagtttcgtttattacgaaaactgtttttccatttaaatgaatcaaatccactacttgacaatcattgataaataatataaaatttcgtcaaaattacttttttgtatattaatgttaatatatccataaaaatgaacttggtatcactctcaacttgttatctcatatttacataatctaagtagacacgaactaacagaaaaacatcattaatttatttaaggggtgttataattgaagctaatttacaaggacgaatacggtcctctatattctgaaaagtcaaagaattctatccttaaagagcctacttattttgaagttgattccaaagacaacttaaatagaattgttgataaaaaaggacattacacttatcaaaacaataagcttcataagataaaacctaaaaatataggtgcatctggcagtaatagtggataccctctcattatggataaaaaaggacactccttggaatatggtagagaccttcttgaagtatcaatgagaaataaactttatattaggaccacagaaaaagaatattgttatgagtacgataccgaagttgaaccagatactattcaaatttttgatgacaaagtgcttttgaatttaaaattaagacaaatggttgtacttgtatctacttcaggtaaagttttaaatagctttggtcttgatagatacagaggtgaaggacaaaaacaattaaatgttcccatgttctctgtatatatagaagatagaaattctatattaatttcagatgccattaattcaagagtaattgaagtcgacgaaaatggaaatataatttggaaatatggaaaggatggtttattaggttcggatcaaggactcttatggaaaccaacttgcgcaagaagactttccaatgggcatactattattgcagattccaaaaataaccgattagttactatagatcaagataaaaatattgtaaatgagattgggcaaacaaatgtttctaaattgtttctcacatatcctcgctctgttcaaatgcttgataaatataattggctggtgacaaatacacacaagaattctatctttatcatgaatcaaaatcaaaagaaaatcataaaacccataaatgattcttataacaagttaaatttattttggccaagatgtagtataaaaaactcggatgatgaaataatcatagcggacggaaagaataatagaataatgtttattgacgataaaacattacaaataaaaaaagtaattgattactattatgaacaaggtaatagaatgacaattattgatcctcatgatattaaaataaaccctaaaacaaaccttcttctcattaccttatctggaaacaatagggttatagaaatgactagtgatggcgagttaattgagagctatgataatctaaacgaccctcattctgcttattacttttcaaatgggattattattgctaatacggaagacaacaacatagttatttattatttttccggcaaaaaagaaatcattaataattttaaatctactaattcatgctgtgatgcctttaagagacctcgttatgcgctaccttataaaaatggatttctaatattagatacagacaatcaaagaattatatttttaaaaaaagagaataacgaatggattggagaaaatgtgcctatctattttcctgatggacctataatgaattatctttgttttcctcggtgcattacatttaacaatgataatgaactaatcttaaccgatactgaaaattgtaggattttacgccttgtgattgacgacactcttattaaggaggagcattcaaatgaaatataaagttgattcggcacatggtggtgaaggttgggtacctagaaagcaagatcactctacagaactaggtcatttctggaataactgtggcgtaaagggcgaattcggtaccctgtcacatgttttacttagaagtccaggtctagaggtagaacaaaattttaatcctgctgatatcctatggactgagagaatagaaccatcgaaagcaagagaacagcataataatcttattgaagtttatcgctcccaaggggtagaagtagacttaattgatgataaagcagctgaatcttttccaaatattttgtatgtcagagatttgtttacaatgacagatcaaggagcaatcctatccaggatggcatcagaggttagggctggagaagaagtaattatttctaaaaaactatctgaactcggtatacctattttagcctctcttcactcggatatgatattagaaggtccagacatattaatagtcaatcctgatctagtatttataggttatggtataagaacaaattataaagcagctatgtatgtcaaacagatactattaggattgggatattccgaagttatcatcattcaaactacttatggctgcggacacttggatggtgtagtgaatattttaaattctcggtatgctgccattgttccaaaaagagtttcatatgagttgtacataggattaaagaggcatgggttttcaattattgaacttgacgacatgtatgaaatagatcagttgatgtcaattaatttcgttcagctaaacgaagagactcttctgattaataagggtgccaaaaatacagtgtctcaatatagctcatgtggctttgaatgtctagaaatagacattagtgaattaacaaaaggaggcggctcaattcattgtttaacagggattttaaggaggatttaacgagatgggcgtttctatagtaattccaattaaagttaactcaatcgatgaaatatatattgatttcatcaattacatcattgatttttcttccaatgtattaactaaagacgttgaaataataatagccaatggaagttctaaaaatatttatatatttgctaatgaacatcttaaacatttgaaaaatgttatacattttatcccacatcgttcaattagaacaggagacaacgataaactaaacgggatatactctgctttaatgtacactaagcatgataacattttattagttgatgatcactatagagtatcaagtgaaacgcttgcagatatattaaaatactatgaaaaatatgattgttttaagtttatgcctaaactacatcaatacccacattcagctttaattgatacatgtggaatgtttattgttaatgtattagatagtagaaagcaatattgcggccatttagcctttaaaaaaagtttatatagtgaatggggatttatcaatagagattctctatttgatgagtttgctatggaaaaacatttacgaaaaaagggaagcagagtcggatttataaaagatatcgctctggaagccaaacaagaaattccgtttaaaaaatttcttgagcagagagtacgttatgcttatgaaaacattgctactccctatcgctttacctttttcgccatgatcttaccacttttaatactgttaagcctgatagacacgaactatggtctgaattttgcattttttctaacaagctggacctttgtcatatcaatagtaggtcaattcatttatggtaaacaaatcaccccttggtacacttcactatatagtcctatttggttctggttttatccttttactacgtggatagcaatttacaagtaccttaccggaggaatcatgtttggcgggaataatattaggagggcaggatagatgaaaatcactcaaaagattatagggccacaaagtattgtatacttcaaaaaagataaaaatagagaatttgttgaaaaaatttccactgaacgaggagaagatgaattagttgatcaaattcacttttataaaatgttaccaaaagagattaagcctctttttccagccctatatgattatgatattaaaaacaggccgtttcgcatgtcaatggaattatgtgattttccaacattaaaagagattattttatacaatactaagcaaaacaagttgaaggaacacttatataatgttatacaggacatatttgaaaaaatacacaacttaaaacaaacacaggcaacaaaaaattatgtagaacatttgtatatagatcgttgcgtcaatagaataatagaaacaaagaaattaatgaaagaagcacaatggataaacaacgacttttacttagagggttcaattgtatccaacccaattcaaacggtttttgaaattataaataataataaggatttattaatacctgaatatctatgcactgtacatggacagctaggtccttctcacttaatgttaaacattcaaaagaagaatagttacaaactagttgatccaaagggatttcatgaatttcatgatccattgttggatattataaaaataggtaggtccttcctctatgggatggagtggttagaagatgacttgtataatattaaatattcttttaaaaatgaatatcttacaatagaagattttaatttaattaactatgatgaagtatatatgaagaagtcatttaaacctataatggatttagccataaataattacaaaaatgctgccctaagagtatatgccttaatttgctgtgatctaatagcaaatttaccttttgcatatttatcaggtggtgaaaagagagtagtagctttatataatctcatatatgctgctagtttagatttgtctcaattaaatgatgctgtaaataaggagaaacatatatatgaaagtctttcaaaataacagatataatatatttaattacaaggaaagttctatctttatagaagatagacaaccccattctgttcttacaatagcaaatttaaaaaatcaattagttgtggtgagacaaatgcgaaaaggaataaataatgaaaccgtcgaattgcccgggggacaggttgaagataatgaaaaacctatggacgcagcaaaaagagagctagaggaagaaactggactaatagcaaatcaatttattcaaataggtaatatttatcctctccctagtttaattaatcgccaaatcacatatttttatactgaaaatattgttggttataataagactattaaacaggatgaagatgaaaatatacatgtagaatatcacaaatttccaaaagtcgagtataatcttaaaacccaaaagtggagggatcaatttcttgcttatggagtatatatctgcaaattgaaaggaataatataaaaattttagaggttaaaaatggatgtccaatctatattatttgatcttgataacactttgttaaatagacaaaaaacttttgaaaattatttagattcatttatctccaagtatattttctataactccccgaccgaaaagaaagatataaaaaataaaataatagatatggataaaaagggagaaaaagataaaaaggaattgttttcagaattacaacatagattaaagtggagattaaccccttccgttgattatttagttgaagaatataaaacaatattcgcaaaaaacagtatagttatggatggaacttttgaggttctaacattttgcaagaataaaaatttaaaattagggattataactaatggagaatcattttatcagaagattaaactaaataacacaaaccttacatgtttttttgattttatcttaatctcagaggaattcggtaaagctaagcctcatcgctctatctttaaattcgctattgataagatggccattgatccacgaaaatcaattttcattggagacaatcttatttctgatatttatggtgcttctaggtttggattttatactgtttggtataatcactctaatatagtcaaacaaaatcccataactgtaaaacctaataaaattataactagtttaagtgaattgttgaaaataaaagactggtagccgaaaggagaaaaaagtgattattagtgttgattttctaaatcatttacacagtatttataataaaaataacgatctatccgaaaatgttaaaagaatattcaaagaatataaatgcagtaatatttatgaacacagtgtaagggtagcacatatggcaaaaaaattagctgtacggtttcgagccaatgaagaatcagcatatatagcagccttattacatgatattggaggtattgttcctaatggaaaaagaattgaaattgccaatatactaaaaatccctctttttcctgaagagatagagttcccactaattattcatcaaaaaatctctaaggttattgctgaaaaagtttttttaataagtgaccattctattcttaatgcgatagaatgtcatacaactttaaagtcgaaccctagtatgttggataaaattgtatttatatcagacaaaattgaatgggatcaaaagggttctcctccttacataaatagtctaatagaagccttagatgtttcaattgattgtgcttcaaatgtctatattaagtttcttatggaaaataaaaataatctaaaggttattcacccttggcttagtgactcttataactattttaaaaaataaccctcaactcaatactatatataatattatgtatttaaatccatcaaagttgtgtaaatattggcaagattctcttaagatagccttgtattttttgtttaacactcttagacctaggattaataactgaaatattaatggtctaagagtgttgattatattgaacgattaattaacatgttttatgtcggaaacaaggcattcaatttacactattatctttatttaccttattaaactaatatatattctattcccccccctgattcacatccaatcgaactaagtcttggttgaatgctttaattttattaattctttttataatgaataactataaacaatattattagtgtagaagattaaataatttcatttttattacaatatgaattaataattgtttttcaaaaaattccatgttataatttggtaaaccactgaaatttaaggagggttttatgagtaaagtatttgataaagaagaaatccttaaattgattccgtgttctgacaaaattgactatatatacttagcggggtcaataatggaaggtttcggaaatgatgcttcagatattgatgtttttgttataagtgaaaatccagatagactagcttatgaacctactaattttacaagagaagtaaacatacaagtaggagaatcattcataaaaaatattgttatagacagtattagatatgattttgagtactatcgttcttctagttttacttctttaatagaaaagttgaataatttgaattttaatacagaaaattatattccaaggtttacagcagatgaaatagatcttttacatagattaaaatttgctgagccgcttctgaataaaagtgcttttaatactattctaaacaatataaattttgaaaatttaaataattatttagtaataactaatattgagtcatatgatggacatttagaagacttacagggagctctttcttgttctgattttggtacttcatttgtgcttttaaaattattattaaaatattctcttaatgcttatttagcgaaatatggagagacaaatccaggagaaaaatggttatttagaaaattaagtagatacgccgaaaaacatggtgatcaacatttacttgataagtatcttaatttattatgttatccttttgagaaagataatatcaaacattatgctcaaaaaactattaattttactcaaccattaattatcaaagctcaaaaataaaaacggagggaagtaatcacatgatttatcaaaaaaatatgtttgtgagattccgtatcatcgatactaaaccttatcttattcttaatgacaatgcatttatcttagacgatgtaggcgttaatatttgggaatcaattgatagcaaaaaaaatattgaagaaataataaataaaatctcaaatgtttactcagtagagtctaataaaataactaaagatattaagaattatttaaaagatcttgaaaaaaacggattaattgaagtgtgtaaagaaatctcataggtagttaataatgtctggaatgggctcctttagtggaggtgagattaatgtataaaaagcctgtattaattaaggtgaagcttcctgttgcgttagagtttgtttaattactacttaactgattgacctatcttttatgaattgaggtgagattaatgtataaaaagcctgtattaattaaggtgaagcttcctgttgcgttagagtttgtttaaatctaaaaccagactaaaataattgatcaaaaaatcaaaggagcccatccctaacattattattaaatcaacaactactcataaaattttaggagtaaggtatacattatgctattagaagaagttttcacgtatatagttctttttgttatagttaaaacatgtatgtttcttataaggaaaattaggggtaatcttttatttgatgtgctaaggaatttattatttttcgtcccttttattttaccagcactttatttaggcttacctaatttaatttttcaaggttcgattaattattatttattatccattttttcatcatttttagctttaagcattaagtataaagaatttaaaccttacttcaataaaaatttttaccaaatcctcccgaaaatttcttttaaagactttttaatattggaaatatctttgataggaagcgctatttttgaagagtttttttacaggagttttgctcctcactcctcttttattgtaggcatggcattgtcaggaatcctatttagtattgctcattatatacagaactatacaagaagttttttcgatttaaagacatatattttattgtttttattaggaatggtttggtattggagttataaaaatactgggactttaattccagcaattttaggtcatttagtatataaccttcctagtatgattttcacctattttcactttaaatcatcaagatttcggtgaggaaaaagggggttataatagtgagtagaatcataattgcaactataaaaagaaattatatagtttcaaagagagtttttccttggtcttttattatagccagagttcttatgggaatctatgtttctgtatttgctttttttacttttaaatatatgtttgatggaaaaacagaaagtcattttttaaagtatagtaatgggatagactatataagctttgtagttctaggagccggtctttatacatattctatatctgtaataatgaatgtaggtagatctcttatgttagaaaatatagaaggtactttagaaagtatacttgtctcaccgtgttcacgtttagggtactttttaggagttttttttgaacaaataggtagatcaagtttagagtttctaatagttatatttttcagtttatatttaggtgccaatattgaaattgagaacactattccacttttaatagtaatcattattactacaatatctcttttcagtattggtatatttatagctactctaatgttatttctacgcgacacctatataacacagaatactttatttatagttatgggattagttagtggagtatcttttccgagggagtacttacctaatatcctctactatttatcctatttgtccccattatcttatgcactttctttattccgaggtgttatgacaggacaaaacattttaaattacacaaaggaaatcttggacatatttgtcttgagcctagcttattgtctttttggtttactttggcttaaatgtctggaaaaaaaaatattagaaaatacatttaactaagggtgatagtaaatgctaattgccaaggatattagtaaaacttatatattgaatgagagaaaaggtttttttataaaaaaaaaaacagagattaatgccttgaaaaagctgaacttaacaattaagccgggtagtattgtagggttattaggagttaatggcgcgggaaaaagcacaactattaaaatattatcgaccattctagcgccaactactggctccttgaaagttaatgaagtcgatgcattaaaatatcctgtagaagcaaaaaaattgttaaacgtaataactggtggtgaaagaaatttatattggaggttaactgctagagaaaacctcgaatactttggagcattatatggactatctaaaaaagaacttaaagactatataccatcatcacttagtttggttggattaaaagactcaaatataccagtcgagagatattcaaaagggatgaaacaaagattacaaattgctagggggctagtaaataatcctaaatatttatttttagatgaacctacattaggcttagacataaatattgcaaaagatttaaggcaatacataaaaaaattagctcaccaaaaaaacaaggggatattattaactacccactatttatctgaagttgaggagctatgcgattgggtttatataattgacaaaggaaatttgctcacagaaggcactccttcagatattgtatcaaaaataataccagaaattcaattgaaaatagaattgtcaaatctaagttgtgaattaaaaaaagaattattgtactatgttggtgcaatagatgctaaaatacattttttcaaagatcatactaattactcgattttattatcatcgaaagacgatttaacttctgatttggttaatattataacaaaatacagaacttccattctaagttttaaaaccgaagaacctaatcttgaggatgcattattaacattaacaagtaaacaaggtgattcaatttatgaattggttaaaggtaattaaagctgaaatatataaacaacataagaattcatttcattcaacaaaagcttatttttcattattaatatggccaatattaaacttaattaatgcctacttatgttacaagccttttaatttaaacgatttaaaattatatagaattaatacatctgacgaattaatatcctttttattaataggttttttcacttatatttcttttaagtcgttaatgcaaagtgctttacaaatgagttatgaaagatcaaatggaactttggaaacaatattcttatccccagcaaatcgtttatcattaatatacggaagaagcttaggatttatattcggtaatatatggatgttttttgcgtttactttttttataatgtgttatatcggatcaatacctatatataatttagtctattttccaatatgtttcattctaatcgtcatttcagcaactttatggggaggcttattaaatactatctttcttttttctcgagatgcttcgatattgtttatgattattgatgatcctatgatgttattttcaggtgtgagaattcctctaactcttttcccaatatgggcacaagtaatttcttttatatttcctctcactcatgttttagctgtagtcagagacttaatgttatttggagatatctcgttatcctcatggaatcatttattatacttattatcagaattattatttatgtatatgataactttatttttgctatcaaaagctgaaaaacatgcccgtattaatggagaattaaccttttattgaataggttaaaaaaaagtaaaaaatacttaattaaagtattttttactaaatttatttcttatagtttattttttaaactacatgttttttatacttttatttagcttgattacattgttaactaaggagaaatacctttgtctaaaggtgtttctttccttagttaacaaatcaatctccaatcatcttactttttttctgacagccatttggcaataacggcggcttccttatcatctacaagccccttcggcatattgccgcggccgtttttaataatgctttcaattttgtcttcgtcgtatttgcctccgacctcttgaagattaggccctgacacaccttctaaatccttgccgtggcagcctacgcagctttgctgatataattcttccccttcagatgcagaggcttcagtcttgctgcctgtatctgtcttctcttcttttgcatcatttgaaccgcaggcagccaaaagaactgaaagcgtaaatacaagcattagtatcgataactttgatttcatgttgagaagcacaactcctttacgatctcttccatattataacctcgtttaagcacgtttgaaaccctcgcccagcacctcacttgcatccgccacaatcacaaaagctgactcatcaatctgtttgacgatttgtttcaatttggtgaattcagtttgcccaaccacgcacattaaaatcggacggtcatcgtcagtatatccgccgactgcagagatttttgtcacgcctctgtcaatcttctgtaagacagcctccttgacagcctgctcctgctttgtaatgatgagcgccatttttgaacgattaaagccgacttgcacaacatcaatggttttgctggacacatagacgccaagcatggcatataagccttgctcaatattaaatacaatcatagccgtaacaacgatcattccgtcaatgatggcgagacacttccccaatgacagaccggagtacttatgaatgatctgtgcagccaaggctgttcctcccgtcgatcctttccctaagtacacaataccaattccgatacctatcccgacaccgccaaaaatcgccgccaggagttcatgatgagtggcgggctgaatatcccttgtcagaaacactactagcggcaaaaacacagaacctgcaagcgtctttagtccaaatttcccgccgagcaaaatgacgccagcaataaataaagggatattaataatccactgtacatacgctgcttcaaaaccatatgattgtaaaatcgtactgatcccgctgacaccgccggcggcaatcttgttcggaagcaaaaatacattaaaggacacggccgtaatcgctgctcctatcaatatgtatacataatcccgcaaaatccacaatgttttattccgtacgtccatcatatatcctccgtttcttccaatgctctccgatagcattttaatccttccctgattagatgtaaataacacccaaatacagtggtaatatgctaaagcagcagtgaaatcaaggatataaggaattaaaaaaacacacccgttgcatcaggtgtgtttttcagcttatgaaagcttagaacgcaggtaggcatcaataaacgtatcaatgtcaccatccattacagcttgaacgttccccatttctgtattggtccgatgatcttttaccatggaatacggatggaatacataagaacggatttggctgccccagccgatttctttttgttcaccgcgaatttcatccagctctgcctgctgctcttcaattctgcgctgatacagcttggccttcagcattttcatggctctttcacggtttttaatttgtgagcgctccgtttggcatgtcacaactacgttcgtcggcaagtgagtaatccgaacggctgaatccgtcgtattgacgtgctgtccgcccgcgccgcttgcacggtacgtgtcaactttaatatcctccgtacgaatatcaatatcaatttcatcgttaaattcaggcatgacttcacatgaaacgaaagatgtgtggcggcggcctgatgaatcaaatggtgagatccgcacaagacgatggacacctttttctgctttgagatacccgtaagcgttgtgtcctttgatgagcaatgtcactgacttgattccagcctcgtcacctggaaggtaatcgagtgtttctactttaaagccgcggcgctctccccatcttgtatacattctaagaagcatagagccccagtcctgtgactctgtaccgccagcaccagggtgcagttctaaaatcgcgttatttttatcatacggctcgctgagaagaagctgaagctcaaactcattgaactcttttgttaatgattttagttctttttcaagctcaagctggagatcagtgtccggctcttctttcaaaagatcatgagtcatttgtaattcttcgtgggattcattcaattttttatacgaattgacataatcctttaaaccgtttgcttcatttataaccgtttgagctttttgctgatcattccagaattccggatcagccatttgttcatctagctcagcaatgcgggcctcctttgattcgaggtcaaagagaccccctaaagtccgctaaacgagaagccatattttcgagctctgctctgatttctgataattccatttcattcacctcattaaaagatccgcaggcgcctgcacgcgccgcggtcagtaaacttgccggggcgaactattcagtacggccgcagcaatttttatattttttcccgcttccgcagtggcatggggcatttcgtccgatatcaaccactttgcgaaccggtgctttctttgcttttttgttatcgtcgccttcttgcggctgatgagctgttgtttggccttgtacaacctcttcacgctccagattgttttcaatctcagctttcatcacaaattttgcgacttcgtcctcaattgattcaatcatatgctcaaacatcgcaaagccttccatttgatactcacgaagcgggttcgtctgcgcgtaagcacgaaggtgaatcccttggcggagctgatccatcgcatcaatatgatccatccatttagaatcaacggcacgaagaacgataactttttcgaattcgcgcatttgctctttgccgaattgctcttccttctcattatattttgtgatgatgcgatccataatgagctcaagcatttcatccggttctttcccgaagatatcgctcttctcaagcgcaccttcatcaagataagttgtgttgataagatcaactagaccgtcaagcttccactcctcaggaagctcttctcttggcgtatagactgcaattgcgcgttcgagagaagacttgatcatattttcaacgatttcacgcaggttttcagagtcaatgacttcaaagcgctgcttataaatgacctcacgctgctggcggagaacatcatcatattgcagaagctgtttacgcgaatcgaagttattgccttcgacacgtttttgtgacgattcaaccgcgcgagataccattttgctttggattggagtagagtcgtccatgccgaagcggtccagcatcgccattgtccgctcagctccgaatctgcgcatcaattcatcttccatagaaagataaaattgagtaatccccgggtctccctgacgtccggaacgacctcgaagctgattgtcaatccggcgtgattcatgtcgttctgttccgacaacagcgagcccgccaagctcttttacaccttcgccaagcttaatgtccgttccgcgccccgccatgttagtcgcaatcgtaactgcgcctttttggccggcctcttcaatgatctgcgcttcacgttcatggtttttggcatttaacacttgatgcggaattcctttgtttttaagcagcttagaaatcaattcagatgtttcaacggcaaccgtaccgacgagaacaggctgtcccgtcatgtaacgctgtgcgacatcctccgcaactgccttaaactttccttccatcgtgcggtaaattaaatccggtcggtcatcacggacaacaggcctgttggtagggatcgtgacaacctgcatgttgtagatgttgcggaattcttcttcctctgtcttagctgtacccgtcataccggcaagtttttcgtacatccggaagtagttttggaatgtaatcgtcgccaaggtcatgctttcgttttgaatctcaagcccttccttcgcttcaatcgcttggtgaagcccctcactgtagcggcggcctttcatcagacgtcccgtgaaggaatcaacaataacaacctgtccgtcttccactacatagtcaacgtccttttgcatcgcaacgtgagcttttaaggcctggttgatatggtggttgagcgcgacatgcttcacatcaaagaggttatcgatgccgaatgctttttccgccttcgtcattccttcttcagtaagctgtacagcttttgttttgatatcgtacgtgtaatccttctccgcttttaacgtgcggacaaaagcatttgcctgtacgtacagcttagtggattttgcagcttgtccagaaatgataagcggtgttcttgcttcatcaattaaaatagagtcaacttcatctattaccgcaaaatgaagcgggcgctgaaccatctgctctttataaagaaccatattgtcacgcaaatagtcgaagccaagctcgttgtttgtggagtaagtaatatcagcggcataagcttcccgtttttcgtcttttgacattgagtttaaattcaaaccgacagtcaaaccgagaaactcgaaaattttccccatttgctcagcgtcacggcttgccaagtattcgttgacagtcacgacgtgtacgcctttaccggttaacgcatttaaataaacaggcagggtagacgttaatgttttcccttcccctgttttcatttccgctatatttccgtcatgaagcgccacgccccccatgagctggactttaaacggaaacatgcctgttacgcggcgtgaagcttctcgaacaacagcgaaagcttcaacaagaagatcatccgttgtcgcccctttttcaagacgctctttaaattcaattgttttatgtttcaacgcgtcgtcagagagattttcatagtctccgcgaatcgcatcaatatcgttagcaattttttcgtatctattcagcgtacgttttgttggatcaaacattttatttaaaattccaagcatttataacgctcctctatcttcacatgcctattttagaggcatgtataaataatttactagtccatgtatacctctcattatcatatcataccttttgttatttccaaagaatttgcaaataagaaaaacaaaaaccttccgcggacatcacggaaggcttctcttcattattcagtcggttcaattaagccatatttcccgtcatttctgcggtacacgacatttgtaaggtttgtttccgcatttgtgaaaacaaagaaattatggccgagcatattcatttgcaagatcgcttcttcactatccatcggctttaaattaaagcgtttctgacggacgatgtccaagctctcctcctcttctatgtcatcctgaaccgcaatatctgtatcagagccaagaccgtttgccaataaatattttggagagccctgctcacggaatttacggtttactttcgttttatgcttacggatttgacgttccagtttgtttgttgcgagatcaattgcgttgtacatatcctcgttatgcacctcggaccgaagcgccagatctgtcatcggaatcgtaacctcaaccttagactccttgtcattgtaaaacttcaagttgacgttcacatcagcatccacgctatggtcaaaatagcgctccagcttgccgatcttcctctcgacatgatcctttaacgcgggtgtcacttcaatattttctcctctgatgttatagttcatcaaagaacgcctcccttttattaaggatatgtatctatttctcttttaccctttacaattcctgctgaaacataaatcttttgtgaaaattcagtgaactttgtcgaattttgtttgtatttgctctgttattggcggttcggaggtatatgtatatgctgattgaacgaaacaaatacctcacacacgcctaattgattaaaaagggttccatacattgatgaatagacagcatccattttctataatgaatcagaaaatgttcctttaaatactcacagaactcatgagagggaaaagagaaagagaccaattgatcaaactccgcaaaaatttggtcaaatgctttcacacaaatttcagcacaccgcgaatccataatgaagagaagtgttgaatgtgttgaatccaaataaaaaaaggcttggatcagatcttggtagatccgatccccttctgtttttgataaattctcttcagcctctatcaaataacacaacccctcttcgatggtaaaaagaagatgataataagctgataaaagcgtataatcttcaatgctcttcaaggcactcacctatttacgcttgtcataatatgtgccgtcaatcgtaatgttgttataagggtttaaatacgtcgtatgcatcacacgttttcttttcatctgctgaagttctgttgcgattgactgcttcagtctttccatttccttcacaatcagctgatcccatgtcaaaataagtttcatctgctttctctcttcttctgaaagcggcagagatatctcctgaatcagttcagaccgtgtagccacaaagtcttcaatttgctttaaaagttcatcgctttccggcgtattttgtatgtgtgacagcatactcttcgtctcagtgtatagttgatctatattattcatgcgatcccgcctgatccgtgccggtccttccgttcactttgaattgcttgtttccaagcatcgcgaaaatctgttacataaccttcaacctcagccagcatgcccgtatcatttttgatatttgcctgtaccaatctgcgatacatataatcgtacatcgcacccatagaagcggaaagctctatgttacggttaagtgtaaaatttaattcctgaataatattttgcgctttaatcagattttcatttttacgttccatatcatcattctcaatggcctgagcggcaagtcttataaatttcaaacagccattatacagcataagcgtcagctcaccgggtgtagccgtattcactgaattttgctgataggctgtataaggattttggatcgccatgtgtcatcctccaaattacatttattgtgctagaagctgtgataaataggacgattgttcgttcattttttgaatcgcagaatccattgcactgaattttgaataatagcggttttctattgtggtcaaccggtcctgcattttggtaatatcagtgctgatcgtatttaaatttttaccgattgaataatcattggttcccattgtcgagttgccggcttttgcttcaatgctcttcaccgtacttttcagggtgtcaccgatgcgtttcataatccctttatcactataggcgctgctgttcgatccacttgtaaataaagcggcgacactttgcggatcttcttgtattttagctttcagtttgtcttcattaatttctagatgtcctcgcatttggtaagcaccagacgttgtgatgccaaattcagttaattgataggtttttccatccgcactaacttgagaataaaaatcagtccgcatttgattcgtaccagtgcttatgctggtatcatttttcagcaaaccgctttttgccttctcttcccagagttctatctctttatcggacatggcttctttttgttcactcgtcagcggcgcatagtctctgtatttttcttctttcaacttttcattcaggctgtcaaccagttcattgtatttattcacaaactctttaatttggttgtaaatcccgtcaacatcagtagatacagatgtggtaacagggcctgtggctgcagttgtatttttgatcgaataagtaacgccattcactgtgaagttgtttgacagcttctccatttcaaagccgttgatggtgacttttgcattcgttccttctttgtaagcagtaatcttattatcagtgtccaaagaaaaacctagctggccagacataaaatctgctgtagcagagtctgctgcttgtatactgcctcctgcacctgttgctttagaagaaaacgcaatggtttccacatactctgtaccattccaaattttatctttaaaagctgatactcctagatctgagctgttaagtttagaaatcacattatcaatcgtatcagcgctcgtcacactaatgttcactgtttttgcggctgtctcaccaggcgcaacaacgttaaatgccaaattataatcgccctgtgtgtatcctgtataattgtttgccttatatgtcgcagcagttgccaaacttgctacttcaatagtagatgaagagtttgctgcacttgcagttcctgtagcagttaacacagattcgtttgagcttgatacggttttactctgaaacgtactcggatatgtcagcttattattagacatataatcttggaattcttttattttcgagtttacttcacgatagctatcacgctgccattcaagagtctgctttttttgtgttagcttattaagcggtgctctttctgtctgcatcagctttgatacaatatcatctatatccattcctgacgccagacctgttattctcgtgaccatttcaaaccactcctaatctactttttttcatctacaaataacccaagaaattcagtcatagctgcataaaaatctagccaccgccttggcggaatttcacggatcacttcatttgtagagtcctctattacttttacatagtattcatttaacttctcatggagctcaaacttcagatgaacttgcgaaggttccaaaaacttgttcattccctctaccatttcagcaaggtcggtatatgaaacttgatgaacaggaacctcactctcatgatctttctgattatgtatttgagtatcatagcgatcccaaacaggttgtaacgtagtgagcctttcaatgttcaattgatcatcccctatgccccaatctatcgtttatatcgactaaatcgagataacattacacatatttttggaaaaaatctcatccgttttagatttcttagtttggaaatacgtttataaaaagtaagtggagaatccggttattatatcatgatttaataacagcaagtggaatgattcggagttagaaatataaataaaagaccttggcaacgccaaggtcctctctaaaattaacgtaacaattgaagcacgttttgcggctgttggttcgcttgagcaagcattgcttgagaagcttgagaaagaatgttgttctttgtgaactcgctcatttctttcgccatgtcaacgtcacggatacgagactcagcagctgttaagttttcagaagaagcactaaggttgttaattgtgtgctctaagcggttttgtaccgcaccaagttttgaacgttggcttgaaacgctagtaattgcagtatcgattttcgcgatctcagtgtcaaaactaaaagtagctgatgaaacatcgatcccttttactcctaaagttgttgcatccatgttgccaattgtaacattaatgttttgggtagcatttgcaccaatttggaatgtaaatcctgctgttacactaccgtctaaaagtttttttccgttaaattcagtacgttgagagataccatcgatctcttcagttaaagcatccatttcatctttaattgcagttaaatcttcaggttgctgtgtacctgtgttaccagcttgaacagtaagttcacgcatacgttgaaggatggcatgagtttcagtcaatgcaccctcagctgtttggataagagagattccgtcttgagagtttttagaagccatatcaagacctctgatttgtcctctcattttttcagagatcgcaagaccagctgcgtcatctcccgcacggttgatacgaagacctgaagaaagtttctccatgttcttttgtgctgcaccgttgtttgaagacaaacggttcagtgtgttaagcgctgcgatattgtggttaattctcatttttatttcctccctgaatatgttgtttaggcacgtccttgtgcctcaattttgtaatcggcgagccatttgtgccctctcccggctacatcattaatatcggattgtctctgattttgttaatacaaaaataaaaaaatcctcactttttttgtgaggataatgcggagatcacatcgctggataacgacgccgcacggttattttcttcctgaatggttaaataaatctctttccgatgaatatcaatatgctttggggcttcaattccaagcttcacttgatccccctcaaccgcaatcacttttacttcaatatcagcacctatttgaatcgcttcgcttattttccgcgataaaactagcatgattctcctccaatcggatgctttgtcgtatatgaggagtcgtgtaaaacgacttgcttagccatcatgttcttgcgattcacaataatgggagccaataaattcgcagtagacttttcaaatggctctgccatagtcaatattgtcatgacttctacgtcttgaatattatcgatatccaaaagttcagcagttgattcatcaagatcaaattcataattcttaaaaaagataaacggacttacgacgataaacgcaagattttctgaagtgacggactgcagtgccacgaatggagagtcttctgaaagcggaagtatgacaaattgtttttcttctaaaaagcctggaatcccgctttcaaaaagaatgatttgttcttcttttatgttcatttggccatggtacttcgtatgaatgatcattgttcacgatccttttctttttacttttcgggtgattctttcgggtattctacatctatatttaaatcagggtattggagcatgtcaaccttaacatttcctggcgtatattcaacaattggcttatgcggctcagcctgaataacaggctttcgcggcgtaatctgaacatcaagctgtgacggagtatattgtattttcaccctagatagagaaggagcataattttcgcctaattgaatttggtgcatttcagagttcctccttgcttgtgaagcgattgggttccccttattttcaatcctcataagctcgtcgccttcttctgcagtacgcgctattccctccattacatcctcatgcccttgttgtgcggcttcttcaattctcttgaaaacatgctttctgtctaattcttcccatgcttgtgtctggtcaatcgtgagttttccaggtgtcaccgatatttccatttccgcactcggctgttcgatctctagatcagcttgaggctgctccatttttaagctggcaggcgtcgttgttaaaccaatttttccttgaacactatgcataatcaatctgggaatctgcatcactctacctcctgaactataaaaaaagcgaactcctgagagccgcttactttaaaaagtcaattaatgtaggctgaacaatttgcgcattaacggccagagtagccctgtgcacactttgctgcgcaataaattcagttattacttcttccagttctacatcttcattgtctgataacactttggtagctgtttcttcttgcgctgacagtcttgtattaaccaattcaagacgattatatctcgctccaagatcagatcgttcagcactcatgccgtcagaaaaatgatcaatatcatctaaaacactgtccatgccatctagcgaaccagaatttagtgctttctcaaaagaatcaagcatttcaaatacattctgcccgctttcagaagtgcctccaaaagctgactttggatctgaattcactttcaatgacatattatttgatatattgactacgacatcagctgtatcagaaattgtataagttccgtctccgttatctgtaaccggaggcttatctgaatttgtgccattaaagatatatctgccgttcacttgtgtattcgcaatatttaaaagctgttcctttaactgctttacctctacgccaatcgcttgccgctccgactcgccgtttgtatcattttgagcttcaaccgctaattctctgacctttgacaagatgtcaattccttctgtaatgtttgtttctgtgttttcgagccaggtaaaggcttgagaagcattgcttttgtactgctgcacttgagacagttgcgtattatactttaagcttttcattgctactacaggatcgtcggaagcttttgagatttttttccctgaagaaatctgcgactggagtttatccagcttcgagtagctcgaaccgatatatctcagtgagttttgctgtatcatgccttgtgttactctcatgtgactctacctaccttcctccaacacccatgccgttgatcactttatcaagtaattcgtcttgtaaagtcaccattcttgcagctgcattgtatgcatgttggaattgaatcatattcgtcatttcttcgtctaaagaaactgcgctcatttgctgacggtttatgtcagcatcatttagctgtgtttctgtattagacgccagtcgattagcctcttgagcttcgatccctagctcgccaatcagacccgcataataatctaaaacactagtttctttaccgttaatggttattttaccggttaaaacatttgctaattttgtagcatttgcgttatcgttggctgcaccagtcagtgagaaagcaatgtttgcgccttttgaatctattatgctgtcagccactttgatcttgcccgccgcgcccttggcaggttcagtttcaccgccagtaaaatcaaaaaagtctccgccttgttcaccgctcttggtcacaccatttctgtgcacttcattgaaagctttcgcgaattcaagcgccatattgtcaagatcagaaagcatttccgggtatacgcccttttcttggccgtctgctgttatatacccgtaagactctataaatcctaaaagggatcccttgctgctaaaggactccgcctgcacagctgtatccccgattgaaatacttgatactaacccagtttcattatcatagttggctgcaagttctgaaacctcgtaatttttaccgtccaaaacagttcctagcgactgtttatttttatcaaggatttcaattgatacagttccttcagcagatgcaagtgcattcccgcctgatttgttgtagttgactttgatatcaaccattgaggataatttatcgatcagcaaatctcgctggtcatataaaccattcggaagaagcccgaccggctctacttgtgcaatttgcttatttaaactgtttaattgagaaagcagagaattgacatccaacacagttgtatttagctctgcttttaaattcgattggacatttgtaagtgattcagaaatataattaaacgtttcagctacagcttgtccttttcgagcaacaacagaacgtgcactttcttcatttgtattattcgataattcctgcagagaattccaaaacgaattgagcacactgttcaagccgctgtcatccgtttcatttaaaacgccttccatttgggacagcgctttggccttcgtgtcatagtatccggcactgttgttttgaagacggtattggtagtcaagaaagatatctcttattctctcaactgattttccttgaacgcccgtacccatttgtcccgctgttttttctgcgtttttagatacagcagggaaatagtcagttgcttccaatgagacccgctgtcttgtataaccatcagtattggcatttgccacgttatttgcagtcgtgcttaacgctgcctgctgagcgcttaacgcccgccttgcagtttcaagccccataaaggtagatgtcattttctgaattcctttctgctaagcttttgaatcaaacagtttcattttgctgcttttcggcagctcagctttaattgatttgctgtaattgaagttattttccttaggaaccagcatatcgtacgaaatagagatgaattgcagcgcgtctcttgtcagctgcctattcatctcatttacttttttcagacgtccgagaacttgagaaagagattcgtatagttgttccagctcttccttttcactgcctgaggttttggtgatacatgcggaaatagtattattttcgctatatccgagaaaggccgaagttgttttgatccggtcatcttctgtctgcgtgattgcttgaatatatttttgctcttttgtcaaaatgttagaaagctcttttgttttgccggctttgagcgcttccgtcttttcttcagacagcgtgagcaggtgctcatgcagaacgcaaagtcgcttcaattgttcaataattgccttcgctgacatgggctttctccttttttattgctttttataaaaattaatcatatttttcgcgatatgatttgcgtctactttgtatgacccgttttcaatttgcgctttaagctgcgcaattttttcctgtcgtgaaccagtgactgcgtcggatgcatgttgcatttctttagcctgtgatgaaatttcaattttatcttgaggctgtgcagcagttttttgcaccgcttgcttatcataatttttttgatatggattaacggattgtgttccaaattgattgattttcataggattcctctcgctttccgttgcagtctttaaacaatcttaacccttttatcgactgcgttttcagttagtttagggaatcagctgtttttggtattataggcatagtatgtgtcttttttactattttctttctcgattttcagagcatcctcgtggttcaaatgatccatttgatccttaatatcggactggcaagccttgcagaatttgccttctctaatcgatgtcccgcacctttcacaagggtatgccaaattaggaagatgagtgatctgaattcgcttctgcctgatgaatttcaatatcagctcttcttccacacctgtttcctcagttatccggctcaaagttgattgccggttttcctgttttcttaaaaatttatagacagtctcaaatgatttttcttcttccttaatacacgcctgacatacggtttgcagctttgtttttaaaaataaagcattgcatttcggacaattagccagttctcccatcttttttctccttattagataatatgcctgtgtcaatttctagtgattatatcggcataaaaacagaatcatttagcttctgatcaaggtaaaagatgacactgaagcggcttttcctttttctaataagcagcgggctgcgaagtgcaaggtggcgcctgttgtataaagatcgtctattaaaatgatattcatacctgctgctgaattattttttgtatcaaaaatgcgctctgacagcaggcgttctgttttctttttctttgactgcttctcattattcaggcgaatgaggggatggtgggaaggccgatctaaacattctgccaagagctgtgcctggttaaaaccgcgctcttcttcccgttccttgctcagcggaataggtacaagaacaaaatgcttatcggggtaagccttagaaaaggttgaagaaaaatcacttttaaatgcatttatgatttctgcatctcctctaaatttaaaacgggagagcgcttctttcatcatatcattatatgtgtaaactgaacggttttgacgcaatagcaaactgtctctgatccttgttctccacacctcgcaatccctgcatacggcatgaacagattgaggtctgccgcacagggggcagatatgtcctgtgattttctttaatttgcttctgcaagaataacaaaccttttcatcaggctttagtaaaaaaagggctctccatgtaacatcttgagaaaattgcgaatcacataataaacagatcagtttatgaatgcctcctcctgcttcgtttgacataaatcgcttggactctctgaaactactgcagcagattcagccaaaatgacaagcattgctgtgtttttttgtttatctaccagctcagctttcgtatatgcgatctttttaagatcagtaacgtaggatggactcactttgtttaaagaaagtgccaatacatcgttttggcatacttggcaagtacaggccatatgaagctggtccatatatcggtcgagcagttctttcattacgatttcttttgaattgacaagcatttttacagctcctcatcatcggttatatgagtatactgtaccacgttttcaaataatggctagtctgtacattcaacttttgctgccaattcattcatttcttttatatgctttcttgcatcgagcatactctttgttttgccgaagtgaaagtaaatgacatcgccgtccgcatattctttatgccggccggttcttcctgcaatttgaacaagtgcgctttccgtaaagatagacgattccgctcctagtacacccgtttgcaccttggggactgtgacgcctctttccagtattgttgttgtgattaatagatcgagctgaccatctctgaattgctgcactttctcctttctatgcttgtcttccgcgtgcacagatgcggttcggcaatgaacacctttaaagcacgcagcagccttttccagaatagaaacggaaggaacgaataaaaaaacaggcctcccttcttttacatgaaactctatccatcttttcaccgctggcggaattttatttcggtttaatttcttcttccagtttccacaccatacaaagcgcggttcgggtaaaggtttccggtggtgtcttgcggggatgcgaactgaatgtaactgtccgttcagtgcttttctttttaattctttaggaggtgttgcacttaaataaacgagggtgctgtttttctttcttgctttttgaacagcgaattgaagggtttgatcagcagaatatggaaaagcgtcaacttcatcaatgatcataacatcgattgcatctttatatcgcaaaagctgatgcgtagtggaaatcataagcggagatagccgccctttgtcatcgcttcctccgtaaagcgctgaaatgtcagcaccctgaaaggcagccttgagtcttggagcaagctctaatacaacatcggtgcgaggtgttgcaatacatacacgcagtccttgatttaacgctgattctataccaggaaacagcatttctgttttgccagcgccgcaaaccgcccagatgaggagctcttctttttttgatattgcttcaattaaaacattggcggctttttgctgtccgcttgaaagcttgccatcccatgtcagcttaatagacttccagtttgattcattttcctctttccatgaatataaaggaacctcctcactcactctgcccatcatgacacaggaacggcaatacagcttattctttccagatgagtgataaaaagaaaaataccgctgatcagtttgtccgcacctattacatctatatctccgtttatttatggatatagaattttcagcagtgatatatccattcttgatatgccattcaatcatctcatcggaaaatgagagctcagtcctgagcaaatgacggcttcgaagcgtctgctgcaattcttttgaaaaggaactgtttttttcaactggcacattcacatagcacgcctcctttcgaaacagtatgcctgaatgaatattttctgtccaactattaaaataagaatataaaaaaatctccgctctaaaaacggagatttggccttatttaaaacaccagcaaattcctaacgcaccttcacccaaatgagtgccgattaccgcgccaaaatagctgttataaaattcaacatgaggatattttgcagaaagctcttcaatgattttcgctgcttcttcctctcgattagcgtggataacagcagctcgcataggcaaccctttactcgcatcttcgtctaaaagctcataaattcgcgaaattgcttttttacgtgtgcgaatcttctcaaaaggcacaattaccttattgtcaaaatgaaggataggctttacctttagaagactaccaatgaaggcttgggcgctgcttaatcgcccgccgcgctgaagatgggctaagtcatctaccataaaataagctcgaactgtttttttcatttcttccagttcttttataatatcttccggcgatgatgctccgtttttgattaattcagcagctttaagggcataaaagccttgagccaagcagctgatctctgagtcaaatggatacacatcaatattgtcgaccatcgaatcagccgctgctgcactgctgaatgttccgctgatcccgctggaaagatggatactgataaccgcatcataagacttgccaagctcttcatacaacgcaaccagctcgccgattggcggctgagaagtcgtcgggagctcattatgttttttcacttcttcataaaagcttttccagtccaactcaatttcttcacggtaagtctcctccctaaaaacaacctggagagggatcatatgtatctgatgttgttcacgcatttctttcggaatatatgccgtgctgtctgttacgactgcaatattcatagcttcgatacctgccttattgctttataactctattgtaagggaaacggcagcctaaaaaaagacctgcctagtaaaaggcaagtctcctattatactatctcatttctacccagccatttttaatggcgaccacaacggcttgcgtccggtcgtttacattcattttttgtaaaatattgctgacatggtttttaacggttttctcactgataaacaatgattcaccaataccgcggttgctttttccgtctgcaagcatctgcagcacttcacattcccgcctagttaaaatatgtaatggtctgcggatttcagggtaaacctcatgttgagggtgtgcagaaactccgcttgttgcaaggcggcggaattcgttaacgaggttgtgagtaaccttcggatggaggtaagatccgccctcagccactactttaaccgcttcaattaatgtatcagcatccatctctttcagcagataacctcttgcacctgttttcagggcatgtgttacataattttcgtcatcgtgaattgatagaataattactttagattcaggatacagctctacaagctgttttgtagcttccacaccatttacgtttggcatattgatatccatgatcacaacatcaggatgatagtgctcaacaatacgagccgcttcgtctccgtcatcaccttcggctaccacttcaaaggtaggttcaaaatccaatatccgtttaacaccttcacgaaataactgatggtcgtcgataataacaatgtttactttagtcacaagccacgcctccttgtattattgttctatatactctagcattcggtcaatatgccttttggctctattttacaaatcatagtcaaagagataacggaaccttaatcataataaatgtcccaagacctattttcgaatctattgtcatcgttccttccaataaatctactctttctttcatgcccagcaagccgaatgatttgtttttcttctctttcgcttccttcaggtcgaaccctttaccgttatcttttatcattaaaatcacaaaatcctttgtgatctcaactttgactgtaatttcttcagattcagaatgctttagcgcattagacacagcttcctgtgcgagcctgaagagcgcaacctcaaactgaggcgctagcctctgatcctctgtttctccaatgcactgaaaatgtattttgaccttcccgttatattcctcggttgtatatagatattttcttaaagttggaatcaggcctaggtcatcaagggccatcggtcttaaatcatatataatccttctcacttcgtaaagggcattccgaacattttggcggagatttttaatttcttggaatccgtcctctgcgccccggtcacggaaaatccgctcgattaattccgatctcatcataacattcgccagcatttgagcgggtccgtcatggatttctcttgagactctttttcgctcttcttcctgcgcctcaataattcttaagccgaaatcctgttttgcctgagcatcagcaagaagcagtccaacttcgcgcaaatcctgattcaagtagttgagcacaactgtaatttggcttactaatgattctgaccgctcaatgatttcctgaagccctagcaatctgcgctccaaatcgtcccgccgttcgcgcaattgcttctcacgctgctggatcatcgtcaattctacctgcagcttatgggctttttcataagcattgcggatttcctcttcactgaatctatgaaaattacggctgacctcggataaacggtttctcgcatggcgggtttgcacttcaagtttatcgccaagctcaatcacttcatacacctgctgtttaatttgtttcagttcttcgaccagctgttcatactgctggcgtgactgctccccgatttgaaaaacctcgtccttgctcccgtcaacggttttcagcatcttcatcaaaatagaatccagcactttggaatccatctttgttttattcataatttccctccgtcacggcgttgtcatatatttttattataaatgtaattgatctgcaaattatgtcgaattataatgaaagaatgcgtatattctagaaaaaaacatttttatatactatctactctttatgataccaaaatacgcacaaaaattctaaagactgtacgaatttgtataggcagtcttttatgcttagcaggagggtcagctagcatgctgcacagctattttactgtgaaagaagcaggagaacacgagattgttatagaaaaatcgcgttttatctgtcatttaagccgtgtttctaccgaacaagaggcacaggaatttatacagaaaataaagaaacagcactggaatgcgactcataattgctcggcttatgttattggcgagaatgatcatatccaaaaagccaatgatgacggggaaccaagcggtacagcgggagtgccgatgctcgaggttttaaaaaaacgcagactgaaggatacttgcgccgtcgttacacgctacttcggaggcattaagcttggtgctggcggattaatacgcgcttatgggaaatcagtgtctgaaggattaaatcatataggtgttgtagaacggaagcttatgcgaatcatgcatacttctgcagattacacatggcttggcaagattgaaaatgaattaagggagtcacaatttctgttaaaggaaatccattattcagaaaatgttgaattcgaaacatacgtggaagaaaaggaaacaaatgctttttctgaatggatgacagaactgacaaatggaaagagtgatattaaagagggagagttgacgtatcttgaaaaagccgtcaatcacataaaggagactgaataatggctgaacgcgttagagtgcgtgtgcgaaaaaagaaaaagagcaaacgcaggaaaattataaaaagaataatgttattgttcgtcctcgcattattagtagttgtggggcttggcgggtataaactttataaaaccattaacgctgcggatgaatcgtacgatgccctatcccgcgggaataaatcaaatcttcgcaacgaagttgtcgacatgaagaaaaaaccgttttctattttatttatgggaatagaggattacgcgactaaaggacaaaaagggagatcagactctcttattgttgttaccctggatcccaaaaataaaaccatgaaaatgctgagcattccgcgtgacacacgtgtgcaattagctggtgacacaacgggaagcaagacgaagattaatgccgcttacagcaaaggcggtaaagatgagacagttgaaactgttgaaaacttcttgcaaatcccgattgataaatatgtcacagttgattttgacggatttaaagatgtgattaatgaagtcggcggtattgatgttgacgtgcctttcgatttcgatgaaaaaagtgatgtagacgaaagcaaacggatttacttcaaaaaaggcgtgatgcatttgaacggcgaagaagccttagcatatgcccggatgagaaaacaggataaacgcggagactttggccgtaatgacagacaaaaacaaatcttaaacgcgctgattgaccgcatgtcaagtgcaagcaacattgctaaaattgataaaatcgcagaaaaagccagcgaaaacgttgaaaccaatattcgcattactgaaggtttagcacttcagcagatttacagcggctttaccagcaaaaaaatcgacacattgagcattacaggttctgatttgtatttagggcctaacaacacatattactttgaacctgatgctacaaatctcgagaaagtcagaaaaacgcttcaagagcatttagattatactcctgatacaagcactggcactttcggtaccgaaagttcaacagacgggactgacagctcaagcagttctggcagcactggcacaacaactgacgggacgacgagcggaagcagctattcgaatgacagcagcacaagctcaaacaacagtacaacgaattcaacaactgattcatcctattaaaaaatgcccggtccttttaaaggatcgggcatttttgcgcagaaaaaaactccggcacataagccggagtttttaattccttttcaccagccgtttataaaactttgtaaacggcttaaatttttcattcacgagtcctgtcacttctgctatgatttgcataaaaataatcaaaatgaagataataaacaaagaaagccaaattgtggcacttttaagtacaatcgcactgatactgaaaataaatccaattaaataaataactaagaccgacatccgatgtgaaaggccaaaggccatcagtctatggtgaatatgcgacttatccggcgctgaaatcggctgtttgtttaatattcttctgatgatagcaaatgttgtatcaaaaatcggtacgcctaatataataatcgggataacgatactgaacaatgtgacacttttatacaggcctaataatgaaagaatcgaaatactataccctaaaaacagtgatcccgtatctcccataaagatttttgccggatggaagttgtaaaacaaaaaccccagcgtgctggcaataacgactaatgagagtgacagaatgagcacttttccgccggatagcgccatgacagcaatcgttgacaggccgataacagaaagaccggcagcaaggccatccaatccatcaatcaggttaattgcgttcgtgatgccgacaatccataataccgtcagcggataagccatccatcctaactcaaatcgttctgttaaaaaaggtactgagaaaaagtccatttttaagccagtgcttacaatcataatggctacacctaattgaatcaaaaacttaacttttgcacttaattgatatttatcgtcaagaatacctaacacaataatgatgaatgctccgactgtaattgccgtcatccttgtttctgtgtaaataccggatgcaagcacgcctgcaaccaccccgataaatatggccagcccgcccatgcggggcatgattttgtcatgtacttttcgattgctgggctggtcaactgcacctattttaatcgcaatcctttttacgattggggttatgattaaaactgtcagcagcgagacaataaacgcaacaacaatgcgaatcatgcgttcgtcaagcataaagaagtctcctttggaattaaatgaagtctttatttatatagagaaccgttccttccattataccttctccttagttattataacaagcttcatcaaaaagaaacacgtataatcaaaaaacgcgcatcccaatttataggactacgcatgtttttgaatccctgtatacttcataatttgtctaaataagcaattccaatcttgtgtgcgagcgatgtttcggcgcatttctttataggtttcgtctccgttttgtccgagaactttttcacaagctgctataaaatcaattggatgatcaccttctacatattcgtatacatacggcttttgcatttttgaggttgacggaagattagtgcctacaacaggttttcctgccgctaaaaattcaaatagtttcagcggaaacacagcttgattatacggtgattgtttatatggcatgatgccaatgtcgataagctccatataatgaggcacttcttttggatctgccggaccggtccatatgacatttggaagcctcagcagctcttgaaacgaaacgtcaccattggtggcatccgggccaacccataaaaatgtccaatcaggcttttgcagggcggcggctttaatcattttaaaatcgagcttcggtttaatcccgccaataaaacctaacactgttccttctctcccctgcagtatactgcgatcgggagcttgtttatttgcagaaaacagctcatactccacaccgttttccacagtatgaaccttttctcgtcctgcagtcagttttttgtctacttccttgtgaagataatctgatgaacaggttattgaatctgctcgttgtataattctcagctctgccgatttaatgacttttcgccggaattcagacagcagatttgatcggccgctgatcggcgccgcccataagtcactgcagtcataaatgacctgatcccaaggatacagcgaagacagcagcgggaatccgggaaacgtgtaccataaacagcaacgttcaccgtttgcagaagcaggtgtaagctcatcgagtaatggggagagcttatgtctgtaaaagacatctgtatatcgtccgaaacgaaacatttttttctgcagcaggtctttgacaacgaattgcctgatgccagaatggacttcttgaaattctttaccttgggcacgcggagccggacatacccaaataacttccttcgtttcctcctgagcagctaaaaattctgccagccggtgccttctgtatctcaattggtcttttccccattcagcagtggcaacgatgacatgaatgattgcttcttttgtttccaccttcatcaccttttctctctgtttgcggctataatctttttttcaccgcgttttttgcatattgaacaaaacaccatgttgctttcataaaatgaagccgttcgatctccctgtagacaaaccacgtttttttcgcagccttccatttgttgctggaaattgagttattgacaagccgatattcagccaggcattcattcattccataggcaataaatcctttttttaaaagagacagccatgtggctaagtcctgtctcgttctgatattcggcatttggatctgtcccgtttgctccctgtcaatcatcaccgtcaagcagccgataattgtatttttcagggcgtcatcgtacgtcaggctttccggcgcatgaataaatttatcgagtggggtcccgtcctgcgccattaagctgtagcccgtgaaagaaaacgcacaggagcgctccatcataaactcaagctgcttttccagtttgtcttttttccatttgtcatcactgtccaaaaatgctacgtagcgcccttgagcgcgttccaacgctttgttgcgagcaaccgcagctccggagttctcttccaaatacaccacatgaattctttcgtctattttttcatactgctgtaaaatgtcgcgggtcccatccgttgagcaatcatccacgataatcatttcccaatgaggatggctctgatctaataccgaatgaaccgtgtcttcaatatagtcacgcgcattataggaaggtgtaatgacagatacgagaggtttccaattggtcatgatcacatctccatcgtatgattttaaaaggattccctgaaaaattcaggaatgacaacgaacataaaggcaatcgtaaggccaatcataacgccgagaactgctttctttttcggagacattccgccgcctgctgtctcacttacggtttcggaatcagtaacacttgccgctttcaggttaagctgtgtgtttttgagctcatacaaaaatctctctttatccactttggaatcctcgcttaccgactcgccttcaagcgcgtctatgctgctgcggatgacggcttctctttctgcatacagcttttgatcgtttttgaggaaggtggaggaaatggcttttaagacagattccgttttatccttatcctcgtcgctatagcttaaagtcagtaacgatttggattccgttttgattgtaagcttctctttgatctctgctacatcttcatccttttcatcaggaagcgcctccttcaaaaaggagtcgctctttaatagaagcggaatctcttctgtgctgttataaaccggatgatcatagctccccacagccaaagtatcttcagctgtatagctcttttgatcagcgatctgtgacggcaggatataccccgccgcacctaatataattggcaccgctatgatccaaatgatatttttttttatgcgacgggctattcttatcaatatatcgttcatataagtctccctgctttttgtagtctgttttatctgtacatcggctcaggcatttgtctggatcgccttaacacattcacggccgcgatgacgagcgccataaacacccaatggaaaaataaatttgaaacagagcttgggctgatacttgataccaggaaactgaccatagcggtaataagtccttctgtgatcagttttgactgattttctaattttctttcataaaacttgtaaagcacccatatgaggtaggcataaacggacagatatcccagcatgatgaacaagccaaaattagcaagaatttcaacaagccagttatgcacctctgccacattgtcagtatcatatacagcataatgctcaagataataggatacatttcctgccccgactccgaatccgtatgaatcaaggaaaaaatgccaagcgtttttcagcagatttgcccgagccacatttgatggaagcctgtcatgaaatgaatgcagcgtctgcggggccagaaacagctcccaaaactttgaatagattttgctggcgaaaagaactgcgaaaagagcaattcccgccgccgacagccatatagccattctctttaaaacaggcggcaatacaatgaagatgtagacagcaatacctgcaaaaatgcccagaaggctggctcttgaaccagtggcaaaaattaaatacaacgcacagagcgagagcacaaggccaattgccttgatgtatccattcttaatgtttttcatcatcgtgatgtaaaaaaagaagctgatggataaaaaggtcgcaaagtcattttgattaaaaaagaccgatgtcggataatgctgcttgtactccggtccgctgtacaatgtggaactcgcaagatgatggtgggtgatatgattgtaaaaaccaatgatcatcagaaataccgtcatcaccagccaaatggcataaacaatcatcagccgctccattttttgcacgtacatgacaataagataaatgaagaagattcccattgccaataaggctaaatacttgaggccaactgttaccgacttggcccacagcagagaaacaaggccatatataaaccaaaaggcgaaaaagagtaaaatcccttttacttgcagcccatgccatctttcaatatgggttcgattccgaaccatgccgaaaatatgaaggcaacccgctgcaatgagcagaagccggtaaaggaacaaactgaaaaatccaagatgaatagcgaaaaatgcattatttaaaaaagtgcaggcgatcaaaatatagattacagccataaagagccgttcttttgttgtaaatgcggttgcaagcgtcagtaaaaacaggccaattgccaacaccgcaagcacaacagccatctgcatgaaacctatatctttatggatggctcccagcaataggacgactccaaatatagcagcggccagtaacgctagcgtatggaccgctgatcgtttgatactcacatgtttaacccctttcctgatgtttcaggagccggcggccgagcctagcagccggcagcttcaaccaagtaacactttttctttttataaattgacgcttcccaagtctttagccaattcttcaagcggcaagcccggaaaatacttgtcagagggttccgttccccgaacagcgggacggccgatagagtgataaatgtatccggctgcctgcatctcttcaagtgaaaataaatttctgccgtcgatgatgactggctgttttaagaggttttttacttttacaagctccatttcttttacttccggccaatccgttaaaatcaggcatgcatcagtgtcttcaatcgcagcatacacatctgtgtaatactcgacctgttcgccaaggatcgctgaagcttcaggaatagcaatcggatcgtatgcttttacatgggcgcccagctgctgcagcattgggataatatcaagcgctggagcggatctcacatcgttcgtattcggtttgaaggctaatcccaggactgaaatggttctccctttgacgcttcccataacagtcaaaagtttatctacaatatgaacacgctgcttttcgttcgtttcaatgacagcttcgatgagcttgaatggatagcctgccgattttgcgatttgaagcagcgcggttgtatcctttggaaaacatgaaccgccgaatccaatacccgctttaaggaactttctgccgatacggctgtcaagaccaacaccatcagcaacttttgaaacgtctgcgccaactcgctcacaaatgtttgcgatatcgttgataaaggaaatctttgtcgccagaaatgcattcgcggcgtatttaatcatttctgcactttctaggtttgttttaatgacaggagcatggaatggctgatgaagttcctcaatgatggcagcggctttatgacttgttgaaccaatcacggcacgctccatattcatcgtgtcatgaatcgctgacccttcccgaaggaattcagggttagatacaacatcaaatgagtatctcccctttgaggctttttgaacgatagattgcaccagtttccctgttccaaccgggactgtgcttttatttacgatcactttgtagccgttaagatgctcaccgattgttttcgccgccgctttgacgtacgttaaatcagcttcacctgttttggacataggcgttccgactgcaatataaataatatctgaggcccgaatggcggacgggatatcgttcgtaaaggtcaggcgctgatccagcacatttttttcaactaagtctgcaagccctggttcatagattgggattaccccatttttcagacttctgatttttgattcatcgatatcacagcaaacaactttattgccgatctccgcaaagcaagtgcctgatacgagtcctacataacctgttccaatgacagctatttttttcacagcgctcatccctctcctgtaaaatgatcttcctatttatattggtcgcagtttcttacgattaaacggacgttttcgtgaccgtctgatactgatgatgcaaggccttggcgttttttcctgcgtcaaattgagcctgcacggtttcatacaagtcatctgctacttccggcttccatatttgctcatgttcgtaccgagtgatcgcttctgccaaggcttgagcggatttcggtttaatcagcagatgttggtgctttccgaacaaagacgacactccgccaacatccgtacagataacaggaacccttagcgccagcgcctcaatcacaacagtcggcatcccctcactgtaagaaggaagcacgaatagatctgccgcaagtaaatagtctcttacatgatgattcggcacttggcctgtgacgatatgccccttctgcgtcagcgtcgattttgcgggaccatccccgacaaagactgcctgaggtgggtcctgcagcgattcgatcgcttcagacagttcaaaaatgcctttctctctgaccagccggccgacatagacagccagacgctgatcaagcgggagtccgagtctttctctgatttcctctttcgtctcctcattctcctgaaaacggctgagctgtatgccaattggcaaaaccgagctgtcaaagcccgaaagctttttggcttcttcctgaagcttgtggctgactgctaaaacaactgacgcagaacctacggcacgcttgaaggctttaaacgctcctttgctgtaatgcggatagacattcacatcactgccatgcaaggtcaggacataaggaatttgcgctgactctgacacgactgccgcagccccgcccgatggcatggcaaaatgagcatggatcagatccggatataggccgcgctgtttcatggtttttaaaacggctgatgcgattctccgatgaggctgcgcccacttcagctggccgggaactgcccgatagaaaggccggtaaaccggtatcccctttctaacctcatactccggtctggcatccttttttcgatatgtctttttcagcatgcggacaggcgctgaatgaaaaggccgtgggcatatcacagtgatatcaagcccgagtttttgcagctcttgcacctgtgtctcatgaaacacaccctctccgggtttcatactgctcggatatacgcttgtgatccacaaaatcttcatgacaaacgtccttttcttagtagtttgcttttcgtttgagggtacgcttttaccaaaagaaagagatagcacagcgccccggccgcaactgaaatggccagccgcatttctgcctgcatactgaagtgttcggtactgaggcttacaccaaacgcgatgatgcccatcgccgcagtaatcagaaatggcttcataatcgactggaaataagctgaaaggttaagcttgatgacatatgccaaaagccagcgcccaatcaggaaattaacaacgctgataatggcatacacccatgcgactgtcagcaggcttcccgtctgtacagctgcaaacagtgataatccgtacagcagcagcacgccggaatcccaataaaacgctaagtcagctcttcctttagccagcagcacagatccatttggattcataagcactcttagtattccgacaatcgccagaacatttaggatcggaacagcagcaagccacttttctccgaaaaccgctgtgataaaggcgtctgacacagacacgagcccgattaaaagcggaaacgagacaagcgccagcatttttgtcatattcagaaagccttctctgatcacgctgttttcatatttgttttttgcgaaaacagggaatgccacccgtgtgacaatcggattgatcttcaaaaccggaatggtgacaatctgataagcgaggttataaatccccaatgcttcagcaccaataaaccggccgatcaaaatcatatcgatatttgctcccagcctgttcacaagacgggatgaaagctgaaatgctccaaaagaaaagaaatccttcatgcctctcaaatcaaaaacaaaagcaggatgccaattttttcggtatactgcccaatataaaatccctttactggactgcagcaggacttgagaaatcacgtacgccaaaatcgcatccatcataaaaaccgctatcgctaaatatccgaatgacaatacatttgaaaaaatctctattttgcttaacgtattaaaatgcagctgcttttgcagcatatactgatattgctgtccaattggcgcgatcaaaaacataatcgccagaatccgaactagaaacaccagctcttctctttgataaaatcccgcaatgacaggactgctcacatataaaagaacaaacagcaaaacgcccgtcataatgttaagccaatacaatgttgacagctggcgctccgtcgcgtcgtctctctgaattaatgctgctccaaaacccatatcgagcacaatctgggcgaaaactgtaaccgttgtgatcatgccgacaagcccaaattctgttaaggtcatcatatttccaagcagggcaaactgaacaatttgtatgattgtaatacacatggttgaaatacttgtccactttgcaccgctcatgatttgttttgtaatacttggcatcatattccctacttctttttaagctcagattgatggtgaataatggcattccgttttatcttgcaccatcacccgtccaaactactttacaagtttttaacataatttttaattctaaagtgaaagtcagattgcgaatgtaatataaatcaaatatcagcttttccttcggcgtcatatcgtaaccgccgttcacttgagcccagccgctcaatcccggtttaacagccagacgctgtgtaaagcctggaatctcattctggaatttttccgtaaatacgggccgttccggacgagggccaatcatactcatatcgcctttcagcacattaaacagctgaggaagctcgtcaattctcgttcttctgataaaagctccgatccttgtcactcgcggatcttgcttctgtgcccaaaccgccccagacttctcggcatctattttcatggaacgaagcttataaagcttaaatggtttcccgcctttccctacgcgttcctgcgtataaatggcaggtcccggcgtctccaaacaaatcaaaattgaaaataccgcaatcattggcagcgcaatcgccaacccaatgagcgcaaaccaaatatccattacgcgctttattgccaaataacgagccgtcttttcagataatgtaaaagaatgtatttgctgaactgagaattcacgactcacattcatgcttttctctgcactcactgacacacacctcacgatttgtttgggatgttatgatgacctatgccagtcagtttagcagacggatgttaattggatgtaaatggtatgttaagaagtgtgaattacgtgttttttctgataaatgttgttaatactcttttactattttatatacaagtcctatttgttttaatcatttcatataaaaaagagacaaatctgtgattagatttgtctctttcgattatctgtaataagatactgtgccgtcatgaatagcttgtgcagctttatctttataaaccgcttgcttcaatttacttgcatctgatgcattagtgataaaggcagtttcaactaaaacactcggcattttagaatatttaataacatagaaagcggctgtttttactccccggtctctcgttccaagattagccgctaactttggttgaatttgttcagccagtctcttgctatttgcagcttgatatgttgtatcgtagtacgtctcacttccatttggtgatgagctatcattagcatttgcatgtatactgataaataaatctgcttgtgcagaagctgctttatttactctctcctgtaaagaataaaaagtatcattagatcttgacagtactggaagagcacctgaagtatttagctttgtattgactcttttcgctatatcaaggttgacttctttctcaaggagtccattgccgattgctcctgaatcttgatcaccgtgacccggatcaataaagattgtttcacctacaactggattctttagctgattagcaaccttggtgcttacggcaggagtgtttccgataatcgtaaagtttgacatgtttttacttccaataattttacgggctcctgtagataaattttcaccatttgtaaggataagagattgcttcttcttagctgccagtgtagctcctgcaatagagtcagggtagctgaatccattgcttacatatacgatgcttgttgataaattaagtttttgtacgatatttgcagcaagctcatatctgtttgaaccactaattcttgtaggagaaggtaacttgttgtataccgtattgctgatacttccagtgcctcctacaacaacggtactcgaaattcccttatcttttatcacagacgttgtcgcactatttatagatgttttatttgtaaaaagaattggatacccgtttttcgctgcataaggaatgacggccggagcgtctgcatataagaagccattcaaaataacagcttttgaagtcgcacccatcgcttttgccacccgtgcagccgtatcataacggttgcttcctgcaattcgtttaatacttatccccaaacttttaatctggttagcagtgttagatgaaacagcaggtgttccgcctacaataattacatttttagtctgcatctctttcaatcttgttttcgtttcatatgaaagcttatcagaattagtgtaaagcaatggcgcattcttctggtaagcaaggggtgctgctgaaatagcatctgcataggaactcccaccaacaattacagctgtacttgctgttgaatacatttgctttgatatttgtacagcagtgccgtatctattgcttcccccgactcttttcactgaattatcggccaaagctgttggcacaaaaagtatgagccccagaaaacacattgttaggacttttatataagaacgcaattgatttcctccttaagtggcgttatatcctaaaataatcaataacttgtcagagttgtacctggatagtaaaatttcaaaattgaactatatgaatctccagcttctgctcttgcttttgctccatattgactcattccgatcccgtgaccatatcctttaccgctgattgtgtactttgaagtatctttttttacagtcacataagtacttttaaatacagtcgctccaatcattgttcttaactcacttgttggtacactaatggttgtaattttgctcaagttataggagccagtactgcttttaacaaaatacttcactttcatcgatgctgtttttgcacgctgcccttgtgtcgttccactaaagcttaaatcgtcaatacttgcaattttgacagaatcagcgcttgtttctttatttttcaagatccagttcttaactccggaaagtcttgcagaatcagtttcagtcgctgaagaccaccaagaagaaggcttcgttaagtccaaagatttcgtatctagctgttgttttgacaaagtaagcgtccagcctatttgaggatcctttgtatctttttttgcaatcaagtaaggtacacttgatgaccacacttcattactagcttctgtgtaaccaccattactggaagaataagctgcagttataagagatccattatatttcagaactttccccttcgtttgctctaccgctttattggtattcgaattccaactgtagccaccataaacttgaaaagcggttgtatcaggtacagtagttcctgtttttgttattgagtaggttcttgcagcgacagtctgtgctttaagagcctcaagtgaccagctagcaggcatttcattcggaattactccttttaagtaatcctcaaatggaatattctcatttaccggtcggatatatttagtagactcaatagagaaattaaccgtgccaagatactgctttccatcaagactaattctgtttgaagtagaatagttttctggtttaattcttagggagtttccgtaagttttgatgttttcaaggtttaattttccgctgttgatttttagattataggtgctaccgtcagctaaataaaattcatcagcaagtgaattctcaacttcagcagaaattgaactggtacttccaataaagtcgtatgcatatgtggctttatctttcgttatacttttagccgcagccggaacgctatcttgtttaataaataaaatttggctgtttttcttcgaggcaagcgaagcgcctatcagtacgtctgcatattttgtcccgttcgtcattacgactttatcagccttcaactttagttgcttaattatatttgccgtaagttcatatctggttgatccaggaatcctttgcacagttgaagtttttttaatttggttttctacactatcactgacgctaaatgaactgcctataatgatgacttgttttggcaaattataatccggaagcttgtctttctctgtaagcaaaatagggtatccgtgtgctgctgcatatggagcaatggctaaagcgtcttgaaatactcttccggttacaacgatcgctttatcatagctgcccatttgctttgcaatattttctgataagacatatctattttttccgcttatccttttcacagcgccatatgatttcagcttgttttctacatcttttgaaatgcttcgcgctcccccaatgattaaaatattatcagggttaaacttagcaatttgtctttcagtagtttttgttaacgtgtcaggctgagtaaataaaactggtgcgttcagttttttcgccaatggaataacaggcaatgcatcaataaaaatatctcggttcaccaatatcactgtattaggatttttccactggctgttggatgcaagagtcgcagtttcgtatcgtgaagcgcctgcaaaacgatccgtaacagcaacattatctccagttactttataaaatcctgttggcgatagactgatgctagatttatttccaatataatttgacaatttaactgagatgtttgagtctgctgcaaaagaaactgatggaatcaataataagattgcagcaagtgaacacactatcaatcgtttgcaagatttcaaaatttcaggttcctccctatatcttagttggcacgttcaatatcttttaacagaagctgaccctcatcatttttttcatatgtaatcgtgaccttatctccactgttaaacttatcaagatcacttgtcgattcttcagtgatatcaagactaaccggctcattatctactgttacttctattgtatgagtatcagctaaccctacataagtaccttcttttgtttcaatgttactgtctggcgatacatcttcaccttgactcttttgactattaaccccgcaacccgaaagaagcaatataaagaacagtaaagcaataaattttttcatttttttcacctcattatattttatcgtcaacctattttatattttaaagaaaaattaagaaacaatgaaacttttttttataaaaaacgactattttaggatttcattcttgtattaaatagagttgtatttattggaaatttaactcataatgaaagtaatttaacagacgaggtgcaaaggatgagaaacgaacgcagaaaaaagaaaaaaactttattactgacaattttaacgataatcggacttcttgtactcggaactggcggctatgcatactacttatggcataaagcagcttcaaccgtggcaagtattcatgaaagcattgataaatctaaaaagagggataaagaggtcagtatcaataaaaaagatcctttttccgtcttaatcatgggtgtggatgaacgcgacggcgataagggccgtgccgatacgctcatttatatgaccgttaacccaaaaacgaatacaaccgacatggtcagcattccgcgtgacacgtatacaaaaattatcggaaaaggcacaatggataaaatcaaccattcatacgctttcggcggcacgcagatgacggtagacactgttgagaacttcctcgatgtcccggttgattattttgtgaaagtgaacatggaaagctttagagacgttgttgatacacttggcggcattacagttaacagcacattcgcgttcagttatgacggttattcgttcggcaaaggagaaatcacgctgaacggaaaagaagcgctcgcttatacccggatgagaaaagaagatccgagaggcgacttcggacgccaggaccgccagcgccaagtcatccaaggtattattaataaaggcgctaatatttcttccatcacgaaattcggagatatgtttaaagttgttgaagataatgtgaaaacgaacttgaccttcgataacatgtgggatatccagtccgattacaaaggtgcgcgaaaacatattaaacagcacgaactaaaaggtacaggcacgaaaatcaatggaatttactactaccaagctgatgaaagcgccctttccgatattacaaaagagctgaaggacagcctcgaaaagtaaaacaaaaagaagcttcgcacaatgtgcaaagcttcttttttatttgcctgtaaatgaatccggttgttctttccggtacccgtaatgaaacagcaattcttccacaatccggcgggaagcctctccatctccatacggattagaagcctgggacattttcttgtactcatcaggatcagttaacagctgttttgccagctgataaatgttttcctcatccgtccctgcaagtttcaacgttcccgcttccactccttcaggccgttccgtcgtatcacgcagaacaagaaccggtttcccgagagatggggcttcctcctgcacgccgcccgaatctgtcaatataaaatgcgatttcgctgcaaagttatggaaatcaatcacctctaaaggttcaatcagatgcactctgtcagaatcaccaaaatgcttctgagccgcttcccggacaacaggattcaggtgcacagggtaaacgacttgtacatcttcaaattcctctacaattctgcggatggccttgaacatgttttccattggctcacccaaattttcccggcggtgagcggtcaagagaatcattttatcctcacccacctgatcgagaacaggatgtgagtaaccatccctaaccgttgtgttgagtgcgtcaatcgctgtattgcccgttacaaaaatagagtcggcctttttgttttcttttaataaattgtctttcgcctggcctgtcggagcaaaatgcaaatcagcaatcgcccctgtcatctgtcgattgagctcttccggaaacggggaatacttattccctgtacggagccccgcctccacatgaccgacagcaatttgatggtaaaaagcggctaggcttccggcaaacgtcgtcgtcgtatcaccatggacaagcacaatatcgggtttgatatctttaaacaactcatccaatcttacaagtgcgttagacgtaatctctgccagtgtctgccgctccttcataatgttcaaatcgaagtcaggcttgatgtgaaacgcatctaacacctgatcgagcatctgtctgtgctgtgcagttaccgttacataggaatctatttcaggatattttttcaattcaagcacaagcggtgccatcttgatcgcttcaggcctggtcccgaaaacggtcatcacttttagttttttcatatttgtcacctggttttctgctatagtaaataaattcatactacatattctacatgaaaatgcatcattttaaatcatttcattcttgattcaaataaaatgatataagttttaatattaaggataaagcttgtttaaaaatggtttatccgatatcataaaaatgtgtaaaaacatattgaaaagggtaaatagagaatagtttaaccataaattttttcgatcataaggaaggtgccttttaaatgaaaaaagtacgtaaagccataatccctgccgcaggtctcggaacgagattcttgccggctacgaaagcaatgccgaaagaaatgcttcctatcgttgataaacctaccattcaatacataattgaagaagctgttgaagccggtattgaagatattattatcgtaacaggaaaaagcaagcgtgcgattgaggatcattttgattactctcctgagcttgaaagaaacctagaagaaaaaggaaaaactgagctgcttgaaaaagtgaaaaaggcttctaacctggctgacattcactatatccgccaaaaagaacctaaaggtctcggacatgctgtctggtgcgcgcgcaactttatcggcgatgagccgtttgcggtactgcttggagacgatattgttcaggctgaaacaccagggttgcgccaattaatggatgaatatgaaaaaacactttcttctattatcggtgttcagcaggtgcctgaagaagaaacacaccgctacggcattattgacccgctgacaagtgaaggccgccgttatcaggtgaaaaacttcgttgaaaaaccgcctaaaggcacagcaccttctaatcttgccatcttaggccgttacgtattcacgcctgagattttcatgtatttagaggagcagcaggttggcgccggcggagaaattcagctcacagacgccattcaaaagctgaatgaaattcaaagagtgtttgcttacgattttgaaggcaagcgttatgatgttggtgaaaagctcggctttatcacaacaactctagaatttgcgatgcaggataaagagcttcgcgatcagctcgttccatttatggaaggtttactaaacaaagaagaaatctaaacataaaggctattggacattcatccaatagcctttttttatttcaacatcaaagtcaatgtatgctcttcattatcaactgcgaagacctgatcaacggcctgccgcaaaaattaataatcccagacaaacacactgattgtagagttaaacaaactaaatgaaaacataaatacaaacatgcagattaaatagtaaatatcttgtattcaatgcaagctaagtaaacaccacttgctaaaagaacaatgactaaacaaccagcattacaaaataattaaataaatttgaagcaattacaacagaaggcagtgaactgtcggaaagttcattttggctaccatattaatcccttttaatttaagagccaggccctcaaattcctctattcggtcggcatgtccaaatatatccatccatcatttttatgatttgcagaaatgttcattatctcaattttcacgtttaacccttcgtcgaagagttaactctatagacttatttttttaaactggtcaaaaaaatcagtgtaataatccattgtataatgcacataaaatttgccccatggatggttttcaaaggaattatagcttttatttttaaataaatctatcgcctcgatatcattgaagctatctaatacatatgcgtcaaatttattccaaatcttattataataatcaacatcaattactttgatgttccctccatttataagcaattttttctgatcttctttatcaaaaaagtgatgaacgtttcttgcactatttaagataattttggttttagggcaatttaatctgacgtagttatagaaaagattaaatttctgtttccatagtgcaaaataattttcaaaatgatcttctatattaaaactttgttttttattttgaattgtaaatttataataattcgttttagggagagtccatctgttatttgtaacaaactggttatctgaaatttctacgtagccaaaatgcacatctgcgaaaaagtccaaaatcaaaatgtctggctgaacagatttaatctcggttagaaagctattctcaaaatccgtctttaaagtgtttttttcatgattagacatgttctcattatcaataacaatgtagttaggtttactcattgttgaaataatggacgattggttttgggtcaatacacaatcaaaaaaatttttataatcagcattaaattgagagttaaagttatcacgtgtaacacaactaccataaacagctacttttttcatttctttattccctctttaatattagttcctagactaataatttgttgataaacacgtttacagttttctttatccgtatacttataaaattgatttactctatcaatatatttggcatccattatacaatcgttttccatacaatttatcagcttatcaactaaagcatctttatcagcaattacttctccaaaccccattgaattgtaatcaaaataccctttttccaagtgatttttttcgtattggaagtaaaaaacaggttttttaagataagcaaagtcaaatgcaacggatgaataatctgtaactaaaatcgcactattattgaaatgatctcgataactttcattaatgtccgcaatcctcactgaactatttttgttgaaatctttcaactgctgaacaatatttggatgcgggaagaatacgatctcgtatcctttttcattagcctcattaatgagtttagcatcatttaataaattattaagttcattaaaataaactgagtttttaaagagtggtgagtaatctcttttccctgtttgcggatttatttttcctactaaatgatttctccatgttggcataattaatatctttttatgattatgattaacaagcttatcaaatctaggaaatccagttagaattacttctctttttgaataattataatgaccattaattatagactcatactcaggttgagcggctgtgataaatagtctaatatttttcttatacttattaagccatcccgaaatatcatctttcgtaattccatgttgaagaaaaacaaagttaaatttaaataagtccttataatatttcctcatattcacaaacgggttgactacataatcatctgcatgtgaagagataatttcatcggcaagtaaatgtaaaaatttgtgcttaggtgacccgtatgcaacaactggtcctatttttttcagcctgttataatctggactatctttactgataataaaatattttttgatgccgtcattctgctgcattgcatattcaaataatgcttcagcattatcatctgccttgttgattctatccataaaaagccatactcttttatttttctttattttatagaggtgttccataatctttcttacatttgatgctttctcagcacctattttattaaaggtcttaaaacgtctttgagcccgcttttcttttgctctaataatctgatttttatcttttagaactactaaattattaagtttatgatcgaaataaatccctataccatttttggtatagaaatcaactatatgtttatccagcgggaataatcgtccaaagttaatttttacttttattagttttccatttgatgaaatcatcatttcaatattcgagttatttgcaagctcaccaactgggatatcaaccttaaagcccaggtactctttaactggcttatttaagcaatataagttgtgtactgttctatcaattttttcggcatgatatatcttgtcattgacacatgctttcacttctaattctgcggcatcaaataatgaaccaaaattaccttcaagggttaaaatccccttttcaatgcttaatagctccattgttatagcttcatatctcatagaattaattaatttctctttaaaatataaattcacattacgattcaaaaagatctttttaaatacattttttttatttcgatatttcaatttgattaaaaaatattttctgtgcaagtttagagatttttgttcaaagattatgtcgtcatctataaatgcaagtattctttctagcaagtcaaaaaactcttcaacttccttatccgtcaaaacatcagttctgtcttctatatttattctccactgcaagtcataggcaatcatatactgaatgtatcttggaacgtatcctaaagttgtaatactatgattaattaattctcgagagaaattcttcaaataatccacataccattttttatcatttttacctgtttgagttgcagatgacgcatcttctcttcgtcgataattatattgtccttctgacacaataccgtatacttggcgcttcattataattttagtcagccattcactatcttcagcgtaggccatatcttcattaaaaaagtgatttttaacagcttcttttttcacgaatgaacttggtgctgataattgaattcctgtatgttctttcaagatatgaactagcctagttttatcaaatttataatttaataagtgtggaccacttgttttaccaaacatcatcattggaatagaaactacatcgactttagaataattcttttcaaaaaaatcatatacttttaaaagggttgaaggggacaatgtatcatcaggatctaagaaattaatatatttacctttggcatattttaaaccctcattacgcgcactacttgctccgccattctccttatcgataaagactatattttctggatacgcttctttatactttaagcaaatttcccctgatgcatcaacacttccatcgttgactaaaatcaactgtatatgatgctcaaaatcaagtgcctgatcaattatgcttgttattgcttcatctaaaaattcttcaacattgtaaattgccattataatagaaaagaaaaaattcttttgttccaagtttttcaatctcctttaatttatttctttttactcaagggtattagattctaatcaacttttgaaatattctagttaaaacattaactttttgaagatcaattaaattgttgtctttttcaacaataaacctaaaaaaagtaactcctatcggaagttttaattgatatgaagaatattttctatccctaactgtggttccccaaataactatgttcttatgttcttgcttgtttattaattttgcttttctcaattttcttccataagagatataaacactatttttatcgttaatcacagactcttcattactcaaacttaccattagctcaattgaaaatttattgactttccatgaagtaataacgattttttcattttctagtttccctaattgaataagtctgttgacaggataaccccatcgtttaaatgaaatgagatactcttttaaatatgttttcatgttttgttttacaattaaattctcatctatatatttcaaaacgtgaaataattccttaaaaaactcactctgttctatcttatttagcacttcataaaccttgttattgtttttttgaaaaataaataattttaaatgattaagaattaaacattgaacataaggtataacttcgctgtactcttctaatgatcttttaaccatttcaccatatccatttgtaagtaaaaaagtatacctgttttttttagaccacgaagtgtctactagagaatcctcactttttctttttctatagaaatatttagcggcaggaataaggccatatttttgttctttaattaaaaacgtattaataaataaaacatcttcccaaaaatccattttttcattaaaagcaagaccaagacgttctattgctttttttcgaaaaaatgttccacctatgtgataatgaatagcagtgtaattatcagttatgtttacaatgctttcaccacttttaaatctataattaagtgagtgttctccatttttattatcgaagaaaaatagcggcagtaccgctaaattaatatcggtatgcttttcaaaaaactttaatacctcagcaatagcatttagtgagactttgtcatcagaatctataaaccctatatatttactattatcacaaacttttaatccattatttcttgccatactgacattcggttcatcttgataaataattttaatattattcggatatgcagttgcgtattgttcacatatgttttttgaattatctatgctattattttcaatcaatattatttctatgtttttttcaaaattaattgtctgatcaataatactgtcaatggcctctcttatatataatcccgaattataaacaggcattacaattgaaaacaacatctcaagtgctcctttaaaataataagtttttatccgagtagtcttccacaactttttttgaatgaatcatcttttccaactaacaaaattggtcataaaatgaagtaatgttttcatcctgtttatagtctcttgttttatgtatggattcaatttacttttatgttgttttaaaaagaggtcccggagcacacttttcaaaatcataataaaaatctcttagtttatctctataaaatttaatatcgggaacataacgcctttttaaaccgacataataagcaaatactgaagaatagtctgttattaatatatctgatattaagtataattctctaatatcattatgatcagaaaaatcataagcaaaacccatgtattcagttaagttaatattttcagatacaagatagtggacccttaaaataacaatatattcattacttaattggtctttaagactttctaaatccaacaccatattaaatttatatttacctttaacataaaatgagttatctctttttattttcagcattccttcattgctattttttttatataaaaaatcgttcctcggatagccctattcaataaacgtctttttaaactgaaacgcatttttaaaaattttcgtagagtaagcattaagggaaatgagataaccgcatttactgacttctataagaaagtttcttttatattattcagtcttcatgccgggcatatgtactttatccatgtcatttgcatttaggggagttccgtgcccagtgtgcacatatgtagtgtttctcggttttagaacctatagcggcaagtggctgtttgttatccaatattttgatgtagccaaatacaacagccatttgagagagattttttcaaataattctcatctgaatcatcaaataaatctttgtctcttttatctacactccaaaatatccatattcatatttattcttattttcctcaagatactcgaaaattgctcttggattacagctgaattgtttgcctgaatagctttcgaagatgagtaatctttcgtttctgggcaaaagcccaattattctaaaaataattgagtatacactgaccaatagtcttctatatttcattaaaatctttgatttcattttagactctttaaatatcaaagaattaaatacttatctcagcaaacaagaaaaaaagaagcaactgaatgattcaagcctcttttagttagtgcgtctataaactagccatgtgttttttgatttggtagttgaaatggcttttgttcttgaaaggtaaactttccagcagcttcatatgtccgtagtgaaataaatcaaatgttccgtacgttatcactttcttcatgagataacatcaccttccaactgagagtaccagaaaaaaaccaaaaactttaacaggttgtttatcatttcgacatattttttacgtaccattaataatgaacaataatagcataagttcctataaaagttaagactctttaaaaatgttaatcaccagcatttttttgtatcaccgttgtattgttgtatattttttgcaggtccaatatcttatctataccctttataacgagttttctttttcggaaaaatcgattcttttgtcgcgtttttaagtgaaacgttttctttctgcaacaccatttattttgtacgcccttctcatattaatacatcgtcaaaacatgaaggaattgtaatacgaatgttaaaagttcctaaagatttttgcggtaagatagagtaaaacacacttgtttttatagacatatagatgaaagaaaggttgatacgatacaaacgaaacctattaattaattagataaagaaaaaaccgagcttcttgagaaagtgaaaaaagcttctaatctggccgacattcactatatcctccaaaaagaacctaaaggtctcggacatgctgtctggttcgcgcccaactttatcggcgatgagccgttcgcagtcctgcttggagacgatattattcaggctgaaacaccagggttgcgccaattaatggatgaatatgaaaaaacactttcttctattatcggtgttcagcaggtgcctgaagaagaaacacaccgctacggcattattgacccgctgacaagtgaaggccgccgttatcaggtgaaaaacttcattgaaaaaccgcctaaagacacagcaccttctaatcttgccatcttaggccgttacgtattcacgcctgagattttcatgtatttagaggagcagcaggttggcgccggcggagaaattcagcttacagacgccattcaaaaactgaatgaaattcaaagagtgtttgcttacgattttgaaggcaagcgttatgatgttggtgaaaagctcggcttcatcacaacaactcttgaatttgcgatgcaggataaagagcttcgcgatcagctcgttccatttatggaaggtttactaaacaaagaagaaatctaaacaaaaaggctattggacattcatccaatagcctttttttatttcaacatcaaagtcagtgtatgctcttcattatcaactgcaaaaacctgatcatctgtattcacaagaaaacgcttcttgctgctgtcatacaatacatcgctatcacttaaggatagtgacgccgggttgataggagaaatgttatgaaaaataagctctgttgctttatcattctccagtacataactgattttttcataatcaaaattcagcgtttttctgccgtcagccttatttccttcagtataaccattcaatttcgattgaatgctggtgctgctgtctcctaggaatttcagaaagtattcataggaagatgctgcgttttgcgagacataagacgtaaatgcagtggcatgcaattcagcgtgtttcatgttagttgcaacagcgctctgtttcacataataagagtgcccgtcaaactttattttcgctgcttgtttgccttttgcagctaccgttacttttgtaccgaatggcagtgtaacgtcagccttctgtttcaaaccctgatccttataagcagccgctttttcatttgctataaacccttgcttattgattgcagttaagcgttcctctgacttgccctttgcatcgccatgatggttcttcacttcattttgcggaatagcgccaaacgaagcaattgtacgaagcggggcattaaagaacatcgttcccgccatgaagacagtcagaatagacaaaatagcaatttgaatggcattggccagtgatttcggctttttcttctttttgcggaaacgggcaaacgcttcaggatcttctttcttcctctcttctgtctgctcttttttatatgtctctttttcttttttcgatagcttattaaaccagtcaataaacgctttgtactctttcacaaccgtttttgtttcatcaaacatacgaagctcgccatagtgcatccaagcaacacggtcacacatcttttcaatctgaccgattgagtggctgacaaagaaaatcgtttttccttgctttttaaactcatttattctgtctacacacttctgataaaacgtttggtcccccacagaaagagcttcgtcaataattaaaatgtcaggatcaatatgcacggagatcgcgaaaccgagacgcgacttcatcccgctggaatagtttttaaccggctgattaataaaatcgccaatctcggcaaattcaacgatgctgtcatacatatcatcaatttctttattggttaaccccatcatcaaacacttgagccggacattgtcccggcccgttaattggttattcaaaccggcagcaatcgcaatcagcgacggctggccgttcatttcaatttcaccgctggtcggcggaataattttagccagcaggttagacatggtcgattttcctgacccgtttattcctacaaagccgattgtctccccttcatacacgtcaaaggagacattccgcacagcaaaaaaaccattatccttagccggaaaaaacaatcctttaatcttgtccgattgttttttatacaaatgatactgctttgaaacatttcgaaacgaaacttttagtttcatcgtaaaatctccttacgtattaaagaaagtcaacaaacttgtctctgaatttcatatgcaggatagaacctactaacaataaaaggaatgtgaacaaccaaaagtacagcgtgtacttcatgtcatggaaaaaccatgctccatctaagaagctgttccggaatccttcaataatatagaatagtggattcaacttcagaacaggcactaattcggggtggctttgaccgagtttcgcattaacatcccaaaaaattggcaacaagaaaaacaaaagtcttgttacggcctgcagcaaaaattgataatctctaatcagcacactgatcgttgagttaaacaaactaaacgaaaacataaaagcaatcatacagatgaagtaataaatatattgtaaccaatgcacactcgggaacacaccattaactaggagtacaatgatataaatcaccatcatgatcatataactaaataagttagatgcaattgccacggacggtagagaactaatcgggaagttcattttagccaccatattaatgcgcttaaatacactatttgatccatcaagtatagttggactgatgaaaaaccatgggattaatcctgccagcatccaaataataaaaggcacttcgcccgctccggttgtcacaggaccgccctttctaatccccataccaaatacgaaccagtaggccagcatttggataagcggatttaagaactgccataagacacctaaataattcatttgatatttagacttggtttcataagccgccaatcttaaaattaaaggaaatgacgttatttgctctctgagtatacgcaacaaatcattcattttttatcttccttagacttaattgtttttgggaatctttctgtttaaaatttgaaagcaccgctgattattgtaacagatcctgcattttttttcacttctcaacaagtatctaaaaagctgccgaaatatcgacagctatacattttataaaataacctaaattattcagctttaaatacagtattaacaaccttttcagatgaacgtcctgactctaaatagcaaaacttatcatagaaaggaccaaaagaaaccggaagcttataatcaggcgatgagatctgcttgatagcctcaatcgtttcttcagtagtttttaccaaaggaccaggagcttctttttcaaaatcaaagtagaaaccacgcaacttatcccggtaggtctcgatgtcagggacaaagaatagcattggccgttttaaatttgcaaaatcaaagaatactgaagaataatcagtaatcagcaaatcagaaaccatatacaattctcgaatatcctcataagcagaaaaatcatatgcaaatccttcaaaaggacctaaatcaaaattctcagctaccagataatgcattcttaagattacgatatattcatttccaagctcttgtctaagttgatgcaaatctaaatcgagatcgaacttataacgcccttttgcataaaactgatcatctctccatgtaggggcatataaaataacctttttatcacgaggaatatttaacctactctttatcaatgatattgtttcctcattattatcattatgaagaaaatcatttctaggatatccagattcaatcattgtcttgttaaactgaaacgcccgtgtaaagatctcagttgaataaccatttggggaaatcaagtaatcccaattagaagcttccttgataaaattccttttatattttttggtgtttgtaccaggcatatggacttcttccatatccattgcaagtctttttaaaggtgtgccatgccatgtttgtaaatatgttgtatgactaggtttcggaatccataatggaagccggctgttaacaacccaatactcagctcttgccatagcgaagagccattttaatgagaggcgattaatgtaaggaattcccttttcatcaaaaggcgctgaatattgtttatttacactccaatacattttatactcagggtggttttcccgcatatattcgtaaatcgctctcggattacaactgtattgtttcccattaaaactttcaaaaatgactgttttccttttaactggcattctgctagccatcatgaatagagatttgtatgttttagtgattaacttgtttctcatttttgtgatcttttttatttttgatactaatctcttcttctttcctttaataaagtatttaatccttgttttcaggctatagtcgtttactctgatacctagagtctgctttttctttttcttaaagacttcataacgaactggtgtgttgtttgttttaataatacttactaatccttttaatttgttttttcgatctcctaaaacaagagcagtgctgttgaactgaatatccgttccttcatcgtcattgcatatatactccataaaaagacgataaacataacgtttttcatttgagaaaggaatttctttcaaaggcactttcacttcaaaatcatacagttccggaacaaaaccatctgctctcatgttttccaggccatgtgtttttctttctagcttgattggaaatttttcctcaataggtgtttctccacccttttttaaaataaggttcaagttttttatccgatattgattttcggaactcaggtaccccgcataacctgttatgcttatttcttcagagctaatctcgatttgatcaaatctgatgattttggcctctcttttcaccttaatagaaaagttgcctttatcagttgtataaggtaaaatcaaaagttctgtggtttgatcgacatgaaaggcgcgctcaattgaatttacttcagcagaaagacgcttcaagagtggttcctgctccgcatcttcatatttttttcgaaattcgacataaaaatcatatgtttgtcccatttcaacaggcataggcaaaacatgagcatttatctcagttttatactctaatgagccagtgttttgaagcggaaattcagattccgttcctgaacgtctctctttcagctttaaaaataactggtaatcctctaaaaattggtgttctgaatcaattgagattaacaattcaagacttcctaaattgtttttcaagcttttcaaaatacatttaatcacagtgttttcaatcattacttttttctgctcctctgtataaaagctctttcctttttgcttccttttattagtgtcaactactaaggacattacccaaaatattaactctcttttatttccgtgaccctccaagagaaattgcctttaactgttgtatagggctctactctatagccattattagtatctatactgtttcctgacaattttgtttcttcactcgaaagtcttcgcattgttttaatatggccatttgcattgaaaacaatataaaaatcaataacttgggttttattagcagctatcttttcaatatttacatctttttcgagatcaattacaaacagttgatcattttgtaagtttgttgaaataatttcagccttattctttctgtccaagcccactaaacgtatttttttaatatcattatgatcaaaattctcaatgtcaatttctattttagttttatcaaaatcctcagtataggaactaatagaaggatctttttttccaacctttttagagaacttctctctttctattcgcacctcaatcatctgattaagagcaaaagcccaattttcaatatagttgggtcttgaatatttttcagccattttaaaagcttgttctgaaaatttttgatgagtactttcatctttcatcaaagagataatagcttgacccaatttctctatattatactgttcaatgacatatccatttgctccgtcagtaactaagctccttgctccgtaatcataatcgtatgttacaactggacatccattgctcagtgcctccatatttgatagaccgaacccttcaaaatgagaggttgaaatggttagccaagctttttgaaactctgagtcagggttatccgtatagcctttcaaaaagacattattctgcagtttggtatcttcaatttctttttttattttttcgaaatcttcacccgatccgaatatatcaagttttgcttcaggaatttctttcacgactaaactaaatgcttttactgcatgtatcagatttttcatagatgcaagtcttgaaataatgacagctttgtatttttcactcggcacattcaatacagcgggatcaagaggcttatcaattgtatgcggagtaaagaaaaacgtctcttgttcccctgaaatcaatttaaaatcttctagctgctcctcagttataaaaaagacagcatccaaattatacatctgactaaatacttctttatagcgacccttaatttgatatttattgctgccgtaatgcttgttatgaataattgctccataataggaagaaggtgattttttcactttaaagacatgtttgtcttgcggtctgctgtccactaaaaacaacttaggtttatcattttgtttttgcagatattctatccaatattgacgcagttccgattcatcttttacttttatctcaccctcaagggagtaccaaataatatgagataattgaacatctttttcttcattgttccatacatagagtttgtctaaatatacttgattttggtcattaatatattcctgcagatacatcttgtttagctgcacatcataatgagtaacgagaactaagtttccgttcttcgtatattcctctctctttatgagctggtttttatcattccaatagtcgacgtaccggatagtttctccatctccgtagtaaattacagacatttcattgttcttcttaccaaacaatctcgacacagtttttgcaaattttcccattccaacttgcttttttatctggtcaaggcctatcctttcttcgtatgatcttttcccatttgttctaacacttaaaaaatcatcgaatagattaataacacttgtgaattttttatcaatcttaccgttgctgtacaattcatcaatttttgaagacaactctaaatcaaaacgaaacgttaagaaaaaggtgttttggttacactcttctccaaataattttgaacgcaataataatgatttcgtcagaccgccataattacttggcagtccaccagagataaaataataatccatgtcaggaatttgttttatattagattcactcaccgcatgtaaagacaattttttactccctttcggcatctagaatatatgatcattgaaatttatatctacccggatactttagtcacaaaaatcaatgtaagcatcaaaaagtacttcttatttcaataagaagtactttaattagatattgaaccaatgatatcaggatcctaaattataaaccagcaatttcctctttgatctttgttgtagagatgccttctgttcttgggaggtaaacaacctcacactgatctttgagaaagtcaaatttaccttcccagtcatcccccataacaaaaacatcaatattatgatcaataatatcttgctttttttgctcccaattcttttcaggaattacttcgtccacatatcgaatggtttctaaaattaatttacggtgctcatagctgtgataagcttttttttgcttttgtaaattgaattcatccgttgaaatagcaacaactaaataatcaccaagctgctttgcacgctcaagcaatttaatgtgaccccaatgcagtaaatcaaaagttccatatgtgataacttttttcatttaaagaaacgctccttcctaatgttaaacactattaaaaacactactgacgttagcgattaaattctaaaaacctgtttgtattccttatatcgacatatttctcgtatgtcttcactgatcattaattatagcataccgcctaaaaaaggttaagtactcatgaggagaaaaacattccaaaatatgtaattacactcagactccattggcaccaaggtctgttgttcattcgttcattcaattgtaaaattggaaacatatttaaatttaatgtaaagataatgttaatcctttgttgaagatttatgttaaaatataaggtagcttgattttgcttttagaaactctcggtttttaactatataaatagaatcttaaaggaaggaggagccagacatgcaaacagagactattcacaatattccttatgttaacagtaacttaacatcatttatcgattacctagagaaacattatattgatcaaaagattggtgctgtcatttccacagtcaaccctgaaattgcatttgcagctattaaagatcgggactactttgatgtactatcttcttcaaacttcattttgcctgatgggatcggtgtagtcatgatgtcacgtttgactaacaacaggcttcagtcccgaatcgcaggttacgatgtttttaaagaacttctgggcgttgctaacaaaaagaaaaaacgcatatttctgtacggtgcgaagaaagatgttataaaaggtgttgtatccaaaatttcttctgaatacccaaacattaaaatcgcaggttattcagacggttatgttcaagatcgcaccctagtggcaaaacaaattgcaagagcaaatcctgacatggtattcgtagctttagggtatcctcatcaagagaaattcattcataactacagacacttgttccctaaagccgtatctataggtctaggaggaagctttgatgtatttagcggtaatgtcaaacgggccccttcctggatgatacgtttaaatttagaatggttctaccggttaatcttgaatccatggcgatggaaaagaatgcttagcatcccaaaatatgctttaacggttttaaaagaagaaaaaaacaaaaaaactttctatccaaagcctgaaaaagatcatacaaaacagatttaaaaacgaaaactttcaaataaatggatgataaaaatgaaaataagatcactactggcgaattgctatttgtattttttatcagcaatcgccttttttctgcaatgggtgaaacctgaaagcaaagtgaccctcctgatctcattcgaagcaaacgcaaaagcgattcttgaggaatatgaacaaggacaatactcttataaacttaacatcctgtatacccagcaggcctctgctattgccgagagcttcccgaatgtagatgcatatttattacaagaaaaaaaccctatccatctcattaaagctgtatacctaatgtttaacagtaaagtgatcataacagataattactttctattaacaagtgtgttaaataagcggaagcaaacgaaatgtatccaagtatggcacgcaaatggctcactcaaaaaatttggtttggaagacattacaaacatgcaacggacgaaaactgatattaaaaggttccaaaaagtatacagttcgtatgattatttaactgttggctcagaagagatggcaaatatcttcaagaaatcatttggaataaaggataaccaattattaaaaataggtgtacctttaacagacccttattaccgagaaaacaagaaaaaaatttcagatactctaaacatacaaagaaaaaaaataatcctctatgcaccgacgtttagagattataatatgcaatcaattcaattgccttttacagaagaacaattaattcatcagttaaaagaagaatatgttttatttgttaagctgcatcccgccattcagaacaatattgatattaaatattccagtgattatattaaagatgtttctaattatgccttgtttgatctactcatggctgcagacatattaatcactgactattcttctgttccctttgaattttcgattttaaataaacccattcttttttatacttatgatttaaaactttatcaacagaagcggggattggttgataattatctttccataatacctggaagagcctgctatgacagtgaatcattaataaatgaaattcaaaccccatttaattattccaaaataaaagttttttccgatagatggaataagtattctgatgggaattcaagccaaaatttattgaatttcatcgaaaatttaataagctaaatgatgacacttgttcaaaacagaacaagtgttcttttttctcttgactaccgaacgtatgtttgctttaatgtaattagttgcttatggcagcaaataataatagaggtggtaaatttatgagaaaaaaagaactgtttgatttcaccaacatcacaccaaaattatttactgaactacgtgtagcagacaaaaccgtacttcaatcattcaatttcgatgagaaaaaccaccaaatttatacaacccaagtcgcaagtggattaggaaaagacaacacccaaagctatcgcataactcgtctatctcttgaaggtttacaattagacagcatgctgttgaaacatggaggtcatggtacaaatattggaattgaaaatcttaatggcaccatttatatttggtctctatacgataaaccaaacgaaacagataaaagtgaattagtttgtttcccatataaagcaggcgcgactttagatgaaaattctaaagaacttcagcgattctcgaatatgcctttcgatcatagggttacacctgctcttgatatgaagaatagacagttggcaattagacaatacgatacaaaaaataataataataaacagtgggtgacaatctttaacctggacgatgcaatagcaaataaaaacaatcctctttatactattaacattcctgacgaacttcattatttacaaggtttctttttagatgacggttatttatattggtatacaggagatacaaacagcaaaagctatccgaatctcataactgtatttgattccgataataaaatagtgctgcaaaaagaaattactgttggcaaagacttgtccaccagatatgagaataacttccgtgaaccggaagggatctgtatgtacaccaatcctgaaactggggcaaaatcattaatggtgggaattacaagtggaaaagaaggaaatcgtataagcagaatttatgcataccattcttatgaaaacttcatgaatcatgtacctatgcttcgatcccctttattaaaaaccgtggggcaccaagatacacctccagaaagatttcaaccatttatgcaaaccttcattttagagtataatgctcaaaacaaaaaatggatggttccgacttcaggttatttaccatcttacacatcaaatttagtccgaaatattactatcaatgcagatggaaacttgcaagtcacattaaatgaacgctatattagtttactgcatcaatcgatagaaggagatttccgcttaaaacaaaaggatatccgaatgggatcctggtattttgctggcggagaaaaatcaaatgtgcttgaaataggttttatgaaagggagtacaaaaatcagacccgatgatgcagccatctcaaatgcttcaagaatgagtatttttatgattgttgcggacaagattgaggtgtgataaacaaataggctgtagctattaaatagctacagcctatttgcaactttctaagttttttatcgatattccggaacatcaaaataaagtgtatagccgtccagcaatgaatacaggctgtacatgcggtttacttgtttgtacgcccagccgatgtctgttgcgtattgatgtgtcgctgtagctgaccatctcattttgtacagtgtgtcctgattgtaagctgtgttgtggatatacgatgagcctatgaatttagctccgccgataatggccgcttcaggtgtgaaccagccctgctcgtacgcatatttggctccgtagtaattcggattgctgtcgtatgctccaattccatacatgttgtatacggtttttccgttataggttaatccattggctaaggcggatgtcccgtttcctgtttcaagaagagcgtgtgagattaaatacagttcgttgatgctatattgattggcggcatcgataaatgcctttgctctccctgtcaggatgcctttacccgcaagcactttctgattgacctcagtaacgctgaggcccgctgtctgtgacagcttgagaaattggaagtagtatttgctgtctctggtaaagttatttggatccacgtattgaactacttcatcactgcttgcgtttcgccagcccaaattgatcttagcccagccgtttatctgtccgatgattttcactttatcgccttttttaaattggccgatcacgtttgtcgggctgacttccggcgttgaccggatatttagtacatcagccgtaacggttgatgttgctatattaatgtacgtgagcgatacgtaagccgctccgtctgtttgcggacttactgtcatttgtttttggaccatatcacgaagcgagagattgtaatttgttttcatgatttgcgggccgtttttgatcttcacgatagatgatgtccatccgtataattgttttagcttcgttgatgccgcagcagctgtatcattgcctgtgaactgctcatttacgctgattttataaagcgtattgcttttcgttgtgtagctgggggttacacttttcgatttaagataggttaacccattattcaatgctgttttgctgctgagctgtgttgtcacgattttgtattgtgtatatgctgtctggcctgtttttgatgttgtgactgcgatatgattttgtttgaaaaatgttaaaacgcggtcaatctcttcttggctgataatagcttcagttgtgatttgatagctgctcgcagctgtctgaccggttttctggcttgctgctgatatatgattcgatttgaaaaacgtgagtgcctgattgactttcgtttgatcaagcagagattcggttgtgattttaaacgtgccagctatttgttttttgacggatttcgcagaagcactcagctgatttttctttaatatgttcaagccctttgtgacttttgcttgatctgatgtttcttctgagatgagctgatattgattttctgctgttgatccagctgctgtttttgcagcttttacttttttctgagcaaagaaggctgctgctttgtttgcttgctgctcgcctaaaatctttgccgtcgtgatttgataagctgcagacgttgtcgtttttttgacgctggatgacgtgtaatgccattttttctttttaaagaaagtgtctattttttggagctgctgttttgttatacccttcatattcacggtatatgatgtgctttttccaacctgttgataactcccggatacgccagtgtttttcttgatttggctgatggcgtcctttactgtactcagccctttgaaataagctgattggacattgtatgactcaacggttgttttttgattgatggacttgtagctgcctgtgatgccagtgctctgtttcagctgctgcaatagagttttggcattggcttcacctgaaatggcggcagttgtaaacgtataataggcttgccctttcactgtttcctttaatgatgcctgcagcccagattccttttggaaggcgtttttgatctgcgctgctctgctgtctcccacgattgtgccagactgaatggttgtgacagacaccgtgtgtgtgatgggctgatacgagcttttaatccccgtttgcttggccaggctctggataagcgccttgacttttgtctcatcagcaatgtctgatgtcatgacgttcatatagggctgagctgctccgtaagcttttacagcgccagccactcccgtctcctgtttcagctttgctaggatagtgttggcctgtttttctccggagatggcacctgacgagatggtgacatatggctgtttgcttccaacaggacttgacgttcctgtaatcgatgtctgtttggcgagtccgctcagtattgctttcgcttctgattcgctatgaatgcctgaggcggaaatttggtaggtcgttgttgtgcctgaagcctgataggatgcatcccagccagtatctttttccagtttggcgacagcttgtgaggcttggctttctgtactgaacgtattcgacggctctactttatatagtgagtagtcggtatacgcggctgcctgggcagaaccagacatggcaaaaaaggcaagggacgcggcggatagaagcataggtgcgattagtctctttttcattccttctcctctttcttattctatgagtatataaaactagtttatttatcggcacgcggttgcttcatttataggtgaatcacttccattttctaataaaaaaaaaacttaatctcgaagtgagattaagtctaaatatgagacacgataagggtacaaggtccttttatcgtaaaatcgggcatttgagccggcaaaataaagtgatcgccttttttgagcggacatgttttgtcctcatacatgagcaaaccgcttccttctatcacgctgcaaatcagaaaggattcatcctgagccatttcagcttcgccattgatgtcccatttataaaccgaaaaatattccccttggacaaatgttttaatggttattccttttctagattctgtcgattcatctatatacccgtccacatggggaaccgtggccgcattgaccgctttcgcaaaatgaagctctctcggacttccgttgctatcaagacggtcataatcgtacacccggtatgtggcatctgaattttgctgagtctctaaaacaagggcccccttgcacaatgcatgcagcgttccgctcggcacataataaaaatcacccggtttaattttgattcttcgcagcaggccctcccagtcaccgctgttgatcattgtgacaagttcggtttttgagcgggccgtatgcccgtaaatgatttctgcgttttccttacagtcgataatgtaccagcattccgtcttgccgagttctccctcttcgttttctccggcatagtaatcatcagggtgaactttaattgacgtatcttccttcacatccagcagctttgtcagaagcgggaaccgatccccctctacgccgccgaatacttcacggtgttcttcccaaagctcgatcaatgtctttcctttatacgggccatttgcaacagtgctcggtccttttggatgagcggaaatggcccagcattcccccgttgattctgaaggaatactgtatccaaatctatctcgtaaagcggttccgccccagattttttctttaaacacaggcgttagaaaaatcggtgattgcgtcatgatccgtacccctcccctgtaaataactgatcatcattttcccggtgcgcccctcttacaaacgcccgtataagctgtcttttttccgatgacaacatatgtacaaagcatcatcttttcattaccccttcaaagaaaacgcttcctatctattatatcacgtcgaaaagaagctttgtttcagccttttcctcgataagaataattctccttttttgatacaaattaataaaaaccgtcaatctgtttacgaaggagagaaactatgcaaatcgactctgatctccagaacaatttagacaaactgaaaaaaacattgggacaaaacgacgatatgatgttttatacatttgctttcggagatagcagacaaaaggcgtgtttactgtatattgacggtctgacagagaataaaatgctggcgcaatacgtcatttctcctttacaaaaagaggcgttagcccataaggaatgctcgattgaagacttatccgccttttttttcggctttcaccacagcgttgtttctacaatgaaagaaatagagcagctcgttttttcagggcaagccattttgctcgctgatggctatcgcggaggattagctttcgacaccaagtcagtcgcaacacgcagtcttgatgaaccctcctccgaagtcgtggaacgcggccctaaaataggatttattgaaaaactgcggacaaacacggcgcttttgcgtgaacggacgagtgatcctaatctcgtcatcaaagaaatgacactcggaaaaaggaccaaaaagaaaatcgctgtcgcttatattcaggatatcgccccagattatgtcgtcaaagaagtgtttaaaaggctgaaatcagtcaatatagataatttgccggaatcggggacgcttgaacagctgattgaagacgaaccattttcaattttccccacaatattaagcacagaacgaccggaccgggtcgaaagttctctattagaagggcgagtgtccatattagtggatggtacgccgtttgctttgattgtaccggctacggttgacgaatttattcattcgcccgatgattacagccagcgctggatcccaatgtcacttgtacgccttcttcgttattccagcatcctgatcaccatttatttgcccggtctgtatatttctctcgtttcttttcacaccgggctattgccgactagaatggccatttccattgcaggcagcaggcttaacgtaccattcccgccttttgtagaggcctttatcatgatctttacgatcgaattgattcgagaagccggattaagattgcctaagccgattggacagacaattggccttatcggcggcgttgtcatcggacaggcagctgttcaggcgcaaattgtcagtgcgcttatggtcattgtcgtttctgtcacagcactggcatcctttaccgttccttcatacgcctataactttccgctgcggatcattcggatcggggttatgataagtgcaacagcgcttggcatgtatggcgttataatggtttatctgtttgtgatcggccatctcatgcgcctgaaaagctttggacaggattacattatcccgatcatggcgcagcctggacaggatttgaaagacacagtcatccgtattcccacgatgtttttaaaaagaagaccgacacgaaacgatcccgaagataacatcagacaaaggtgatggctatgaggaaatcagagcataaactgacatttatgcagacgctcattatgatcagcagcacattgattggtgccggggtgctgacccttccccgctcagccgccgaaaccggcagtccgagcggatggctaatgatactgctccagggcgttatttttattatcatcgctctgctttttttgccttttcttcaaaaaaacagcggaaaaactctttttaagctcaacagcattgtagctggaacattcatcggctttctattgaatttatatatctgtctatatttcattgggattgtttgctttcaagctcggattttgggagaggttgtcggattctttttgttgaaaaatacgccaatggcagttgtggtgtttatatttcttgcagttgccatctatcatgtaggcggaggcgtttattcaattgcaaaagtatacgcttatatttttcctataacccttattatttttatgatgcttctgatgttcagctttcgcttgttccagcttgattttatccggccggtatttgaaggaggctatcaaagctttttctctttattcccaaaaacattattatatttctccggatttgaaatcattttttacctggtcccctttatgagagatccaaagcaagtgaaaaaggctgttgctctgggcatcgcgacttccacattgttctacagcattactttgctcattgtgattggctgtatgactgtggctgaggcaaaaacggtgacatggccgaccatttcccttattcacgcattagaggttccgggtatttttattgaacgatttgatttgttcttacagctgacctggacagtccagcaatttgcctgtatgctcggatcctttaaaggcgcccatatcgggttaacggaaatctttcatctgaaaaataaaaacaatgcatggctgctgactgcaatgctggctgcgacgtttttcataacgatgtatcccaaggacttgaatgacgtgttttattacgggacgcttcttggatatgctttcttaattgtgattacaattccattcttcgtctggtttttaagctggatacagaaaaaattagggagggggcagctacaatgaaaacagcaacaaaattctccgtcatgttttttatgctgctggtcctctgcgggtgctgggatgtcaaagatatcgagcaactatccttcgccagagggctggcgatcgatgagacagatgatcaccagtacaaactgacgtatcaaaaccttcttccccaaagcgaagacagccaagcatccggaaaacccgaatttgtcaatgtgacgtcccacgggaaaacgattctggaagcagtcagtgatgtatccatcaaggaccctcctgtttatagcgatcatttaaaagtcattcttctgggagaaaaactgatgaggaatcaaaatgtagaccaagtcctcaaccactttatccgagatgatgagctgcggcgaagcagctatttgatggcagccagagggaatgcagctgatgttctcacaaaaggaaaccccaatcagcagcagccgatgccctccgaaaaactgattgatttgacaactcacagcggatataacggtaagattatgataccgctgcgcatcggaagagcttctgtctactctcagaacgggtacagttatcttattcaagccgtgaaaaacgaaaagggaaaagccaagtatgacggagcaggcattatcaaaaggggcagcaataaactcgttgggtttctttcagctgatgaaacccaaacactgtcatgggtcatggggacgatccaaggcggtgtcatgccgacgacagataaaggacatccgattacgtttgaaatcaaaaagtcgaaaaccaaaattaagcctatcattgaaaacggaaagcctatctttcatatttctgttaaaacgaagggcatcctgacagaagaccaaaacccgaatgaaaactcctttagcaaaagttatttgcacaggctggaaaacatttttgaaaaaaagcttgaacgagatgtaaagcaggtaatggataaactgcagcacgagtataaaaccgatccggtctttttatcagaccacataaggattcaacaccctgactactggaataaagtaaaagggcattgggatgaaatattttctgagactgattttaagtacgatatttcttttaaaatcattaactttggcacggtgggaaagtaagcaatcaaaagggtgcgcatgatcgcgcacccttttttatgttccgacagtctgctgttttccggccgatcctccctgtccgtttttgtcccgtaaatcctgctcaatttcttcaaggctttttccctttgtctctgtcactttaaatcggacaaataagaacgccatgataccgatcgcggcataaatcaggaataaataactgattccgatcgcttccattaatattggataggttaatgaaacaatcagtgtcccaacgtgcaacattaaggtcgaaacaccggtcccgattcctctgacgtgaagcgggaacaattcaggaagcatcacccacacaaccggtccccagctgaccgcaaagacaacgataaacacgcctaaacaaatgacggtcgtccatgaggcagccggagtgttatcgaaaaagagatttactaaagcgagaacgatcaagctgatcaccatgcccgcattcccgaatagcagtaacggctttcttccaatcttgtcgataattttaatcgctactaatgtcatgagaacattgactgtgccgattccgaccgtgcctaaaatcgaagcggagtttccgaatccgacgtttgtaaaggtctttggcgcatagtagatgatcgtattcgttccgataaattgctgcaaaaaagcgagtcccaaacctgcaataagcgctgggcgcacccatggatcgaacagctccttcaggccgccttcatcctgcttttccgcttcttttatatcatgtatttcctgatcaatatcttttgtgccacgcaatttttcaagaatgttcttcgctttgctttcttcgccattcgtgaacagccagcgcgggctctccggcataaacaaaatgccaataagcaagagcaatgacggcacagcagccaatccaagcatccagcgccacgcttcggcatcggcaaatatgtaattgacaatgtaagaaagaaggatgccgaccgtgatcatcagctgattcagtgatgacagcgccccgcgtttatgttttggcgccagttcagataaataaaggggcacgattgtcgtcgatgttccgactgcaagtcccaaaatgatgcgaaacagcaccatgactcctgtatttggggccagtgccacaccaagaccgcctatacaaaacagcagcgcggctgccataattgctttttttcttccgaaacggtcagtcagcttgccggccgctcctgagcccaatatcgccccaaccagcaaggagctgacaacaagaccttctgtaaacgcgtttaagcctaactcctttttcataaataaaatagctccggaaatcactccggtatcatagccatataacgcgcctccaagagctccgaaaaaataaagccatatatttgactgctttttcataaagatgactccctttctccatcagctgcaatgacattgtctgtgggatttttttagaaatcttttagcctctttttccggccattaaacctttttattttgctgatcataagttttccaatcatttacttgtatttttttcaatgtcgccgaaacattttacctgctgcggcgtccaatataaggtgattcagtacatcatcgttatcaattttcaaaaacaagaacttataaatataggaatatttatcgaaaaatgtctttcgagtagttgccccatggcaaatagaatggtacgcttcaaatattaaagaaacgtgaggtattgatatatggaagaacgatcacagcgcagaaagaaaaaaagaaaactaaaaaaatgggtgaaagttgttgccggattaatggcttttttaatcattgcggcaggctctgtcggcgcctatgcttttgtaaagctgaacaatgcttctaaggaagctcacgtcagccttgcacgcggagaacaatctgtaaaacggatcaaagaatttgatcctggaaaagattctttttctgtattgctcttaggaattgatgccagggagaaaaacggcgagaccgtcgatcaggcaagaagtgacgcgaatgtgctggttacatttaatcggaaagaaaaaacagctaaaatgctgagcattccgcgtgacgcctatgtaaacatcccaggccacgggtatgataaattcacacatgctcacgcttacggcggcgttgacttaactgtgaaaacagttgaagaaatgctggatattccagtcgattatgtcgtagaaagcaatttcacggcttttgaagacgtcgtaaacgagttaaatggcgtcaaagtaactgtaaaaagcgataaagtcattcagcaaatcaaaaaagatacaaaaggtaaagtcgttcttcaaaaaggaacacatacgcttgatggggaagaagcgctcgcttacgtaagaacacgtaaagcggacagtgaccttttacggggacaaagacaaatggaagtgctgagcgccattatagataaatcaaaatcattaagctcaattccggcttatgatgatattgtggatacgatggggcaaaatttaaaaatgaacttatcccttaaagatgccatcggcctgttcccgttcatcacttcattgaaatcagttgagtctattcagctgacgggttatgattatgaacctgccggagtctattatttcaaattgaatcagcaaaagctgcaggaagttaaaaaagagctgcaaaacgatttaggtgtataatgaacgggatggcgattacgccatcccgttttacatatttccttgttgaaaattatcaaagtaacgtttagccttaatttatatggattatgtttcacaggcaagctgaacatactacacgaagcagcttcatttttaaggaggttcccctacatatgaaatgtattgcgattgatctagacggaacattactgaataaagaaagcgtcatttctgcggaaaacagagaggcgatcaagcgggccgttgatgccggcatcctcgtcaccatttgcacgggaagagcgacatttgatgtaaaagcgctgctggatgacttggacatccctatcattgcagctaatggcggtacgatccacgacacgggttaccgtttgatcagccggacattaatggatcaggaagccggtaaagcgattgctgattacttactttcaaaaaacatttactttgaggtatatacagatgaccatctgctttctccttttgacggcgaagctaagctgcacgcggagcttgacattctaaagagcgcaaacccaaacgagcagacggatgaattgtggcagggagccatgactcaattcaaacagtttggcattaaaccaatccctcatatcgaatcggtttttgacggcggtgaaaacatttataagcttctttgcttctcctttgatatggacaagctgaaacaagcgaaggaagaactgaagcatcataaaaaactggcgcaaacctcttcaggaaaacatattatcgaaatcctgccggcctcgtcaggaaaaggacgcgcgttaacaaagctggctgacctatacggaattgaaacacaggatatctatgcgatcggcgatagtccaaacgatttgtccatgtttgaagtcgccggacaccgaatcgccatggaaaatgcgattgatgaattaaaagaaaaaagcacctttgtcacaaaaagcaatgacgaaaatggtgtggcctactttatagaccagcttctttcaggacaatatgcataaagaaaagactccagagattggagtctttttcttttattgcacccgtatacttcctgcgtatttatccttccaatatgtgctcgtgttcatattggtgatggtcacgccgtttgataatgtaacgtgaacaacttgtccgtttccgatatagatggagggatttaagcttgttgattgaaagaacacaatgtctcccggcttcaggtccgccttctcaatcttagttccggcattgtactggcttattgcgtatcgaggcagggaaataccggctgctttctggtagacatattggacaaatccagctgtatcaaatcctgtctcaggtgttactccgccctgtttgtaaggcacttctccgacataaagcgtcgcttcggaaacaatcggattttctttcgggattgtcaggttgtcaaatcggcgaatacccgtcatcttcgatttccagtaatcctctgacaaataggaaatggttactttttctgaccggcttgcctgaatgaacctgcctgcgcccgcataaatgcctgcatgtgaaattcccgttttatacgtattgctgaaatagacgacatcaccaggctttatgttctgaggggctaccttctcgcccactgcccactgctgttcggctgatcgcggcagataaatgccgagtgcctgttgaaacacatattgcacaagccccgagcaatcaaagccctctgacggcgtgcttccgccaaacacatatgggacaccgatatatttttcggcctcctgaacgacaggaacatcagccgttgccggatcggcagcgattcgtctcgccccgatataagttccgctccaatagctgctttttttgtaattggtgatgataaccccttttgactgtgtactgtgaaccatttggccgtctccgatataaagggcgtcatgtgtcggaacagtgccggtgcttccctctttcttgaaaaacaaaatatcacccggcttcaggttttccggctttacagctgttccgattttatactggtcgtttacagatctcggcagatgaatatcagccttactgaacacatattgtatcaatcctgatggatcgaaaccctcttttggcgtttccccgccatatttatactgatatccaagcaggttttttgcttcactgacaatcaattctgatgatgtatcagcttccgcaatctccgcttttgtcataattggaaccaaaaaacaaatgataaccgccacaagcaaaaacttcttccagtttgccagtgtgttcacttttattatctcctcctctttttgcagttttaacatcggtatttttttgaatatgttaagagactttttaatatttttacagaatgaatatgctgggcaaataaaaagagagtgtctcctcagacactctcttttttgaattatttattggcgtttaccggttcttcctgctgctggattttattcatttccatatcaatcttctgtttttcctgatctgtcagctgatcattgaatttaaaagctgacataaacatgaacacgatggctacggcaacaaacggccagatggctttgacaaatttcatctttatcactccgtttatttagattttagtttgtcactatgatcaatatcaaacgtcagttttccgtcttctactttccaagcgaaattagagtctttcgtcagttcgcgaataatggttttctgtttaaggctgtcttttttcacaggtgcaggtgtcgcttcatggatatcgatcggtgtcacttcaaagcggcctgttccatttttcttcaggtgatactgaaccagtgcactgtctcttgttctcgtccagccttggtcaaagacaaagttgccgaggctgtagaaaatgacggttccgttatatacttcaatcggttctaagacgtgcggatgatggccgacgatgatgtcagctcccgcatcagacatggctcttgcaagctggcgctggcggtcgtttggatcattgtcatactcttggccccagtgtgactgcacaacaacgatgtccgcatgttttttcgcttctgaaatcatagggatgaagatttcaggatctgcgggcagcacgcccggcgtattctttttagccgcgaaacctttcccggacacatcggtaaagccaagcgttgcaattgttaccccgttgactttctggtacgaaattttctttttcgcatcacttaagctgtatcccgctccaacgatatcaaggttttgcttcgcaaattctccaagcgtatctttcatgccctgaacgccgtaatccattgcgtggttgtttgcgctgttgagaactgtgaaattcatgtccttcaagactttcactgattccttattcgtctgcagatgaatctctttatctgcttgtttataattcttttgataggttaccgggttttcaaagtttcctgctacataatccgaagctctaaagatcggttcaacatattgaaaaatactgtctgcccctttttgctccgttactttttcaacatagcgtcccatcataatatcgcctacaaatgaggctgaaagtacgtcgtcagaatacgttttgaccttcggcgtttccgcttttcccgcccacatgaaagcgaacataaggacaaaaacgatcggaatggcaataaatacgtgcttattggttttctttttttgctgttttgtcagctttagcagcttttcatgaaagctcagttcttttttcatcgtttgacacaccttacattaaattaagtagtaaacaaacatgatagcaaaggtcgctccgctcaatagcagcgtgcttccgaacgtaatggttaaaccttgtttctgaatggtattggcaattaaacctggcacgatgatgccgattcctcgaaattctgcgatttcaaatggtacaatcgggtatagaaaatcaaacgcgatttttaggacgatccctgttatcagcatggcagcgaattttctgcgtccgtacaaaatcataaatttggataaaccgtatttcacgataacataagtgagcaagctcactagcaaaacaagtaaaataaagaccggctgattaaacacaagtcctaaatatcccggtacaacaagtcctgccggcacgatccctgttttttccgcaaaaattaaactgagtagtacacctaaaattagtgcgatgtataaatctgatccgaacatgtttgcatttccccctagcttacgagctgcttaaccttgtattcgtggattttttcaattaaaggctctgcggcaccatgaatattgccgacgccatatatgacacggttgtgcattcttttctttaacaattccataatttcatctgttgacttatactctagatcatgcagtttgtctgcaggaattttgccttcttcgtaggcttttacgaccggttctgttgtttcaccgattaagatcagttcacttgcttcaatataaggcaatacgtcatttgcgaattgctgtgtccgatcgacacggtctgcgcggcagttcatgatgatgatcggatcatcggtcgggtaaccgatttcttttacacgtttccatatattcaaagtagaagaagcgtcgtttgcggcaaacccattaacaaagtgcccaggctcgctcggactgatcagcggaagaattctcattgctcccggatctggcggcgcattcagcattcccttaaatgctgtttcttcgtcaatgccgagtgcttgagccacacccagcgccagagaagcgttatcagggaataccatgtattcaaatttacgtaaatactcatctgtaatttttgagttatcagcaatgatgacttttgtgtttcgttcttttgctttttgtttaaagaactcggtatattcactatctgtaatgacaagatggccattataaggaattgtagcagtaaacgcttctgcaatttcatcaagcgtcggccccatgacatccatatggtcttccaaaacattcacaatgacgccgatattggcctgcagaagttcttcctgaaagatgatttgataatctgggttaacagccatgcattcactgacaatcgcgttagcccctctttctactgtttctctcatgacttctttttgctctccgatattcggcccctgaggtttccgtttaatcggcttttcctccggtgtgtcccagtaaatcattcttgcatctgttcctgttgtttttccaacagtcttgtaaccggcttctattaatattccggttgtcagccttgtcacagtcgattttccgcggatgccgttaatattcacccgaacagggagggcatcaatgtttttctgatgtcgtcgtttttctaatattccgatgaccagtatgacagcacaggctataatgagtaaccacattgcttttcgacatctccttctatattgttgtaaattcattcatcagtatatagaatcactatgaattctcaatcggcattatgtaacataatcttccctaatcgactaagccaaacttctcttttgaaagagattttatacctacaaactgttttctatttttggaaaacagcaggacttataccttatcacttttttaaaaaattgaagagaatgcgctttcatttttctcctgatatccttctggacgtatagtcacaccctgctgtttgtatttaatatgcatttcaaatcaatctttttttcagcctgtgttatcaagcatttcctgctatcatgcgtgtttccggttcttatgaacacaaaataattttatcctgtttcttaaggacaaggtcataatgtcatcctttctgcatggaataagcaatatgaggcccattccaaaatgactaaggaggttcgagatgaaaacgctaaacatacgagtccgaattctctaacataattaaacattttctgggatgatagtcttttctgtttctcaccatttacaggtctaaacgcatgactttgaaacaattttaataaaacttaatatttgttcaagaaatcttcatccatatttgtgaagactttgtcaaaaaaagagtgaaaaccttaaatttttcaattatatatacaatttacaagtagatttcttttgatatttttattgctaacttcggattgttcatgataatctatatatgtaaacggttacataaacaaggaggagctgttttggctacaattaaagatgtcgccggagcggcgggcgtttcagttgcgacggtttcccgcgtcctgaatgataatggctatgtacacgaagaaacgcgaacgcgtgtcatagcggcgatggcgaagctgaactattacccgaatgaagtcgccagatctctatataaaagagaatcccgactgatcggacttttgctcccggatatcacaaaccctttcttcccccagcttgcccgcggtgcggaggatgaattgaaccgggaaggctatcgtcttattttcggcaacagtgacgaggaattgaaaaaagaacttgaataccttcaaacctttaagcaaaatcatgtcgcaggcattattgccgcaacaaattacccggatctcgaggaatacagcggcatgaattatccagttgtttttctggacagaacactggaaggggctccttctgtgtccagtgacggctatacaggaggaaagttagccgcccaggctatcattcacggaaaaagccagcgcattacgctcttgagaggacccgctcacctgccgaccgctcaagaccgctttaacggcgctttggaaatcttaaagcaggctgaagttgattttcaggtcattgagacggcttcattttcaattaaagatgcacaatcaatggcgaaggagctgtttgccgcttatccagcgacagatggtgtgatcgcgagtaatgatattcaagccgctgccgttttacatgaagcattgcggcgcggaaaaaatgtgccggaggacattcaaattatcggctatgatgacattccgcaaagcggacttctgttcccgccactttctacaattaaacagcccgcatatgatatggggaaagaagctgccaaactgcttttgggtatcatcaaaaaacagccgctggcagaaacggcaattcaaatgcctgtcacctatataggaagaaagacgacaagaaaggaagattaagatgcgtaatatttgtgtgattggtagctgttctatggatttagtggtcacctcggacaaacgcccaaaagccggtgaaacggttcttggcacgtcatttcagactgtgccgggcggcaaaggagcaaatcaggccgttgccgcagccagacttggggcgcaagtgtttatggtcggcaaagttggagacgatcattatggaacagctattttgaataatctcaaagctaacggcgttcgcactgattatatggaaccggttacacatacggaaagcggaaccgctcatattgtgcttgctgaaggcgacaacagcattgtcgttgtcaaaggcgcgaacgatgacatcaccccagcgtatgcgttaaacgcgctcgaacagattgaaaaggtcgatatggtgctgattcagcaggaaatcccagaagaaacggttgatgaggtgtgcaaatactgccattctcacgatatcccgatcatactaaacccagcaccggcccgcccgctcaagcaggaaacaattgatcacgctacctatctgacgccgaatgaacacgaggcttcgattttattccctgatcttaccatttccgaagctctggcgctttatccggcaaagctctttattacggaaggaaaacaaggcgtccgctattcggctggcagcaaagaggtgctcatcccgtccttccctgtagaacccgttgatacaaccggagccggtgatacgtttaacgcagcatttgccgtggccctggctgagggaaaagacattgaagccgcattgcggtttgccaatcgtgccgcttccctttctgtctgctccttcggggcccaaggcggaatgccgacaagaaatgaagtagaggagctgctttcatgaaaaaacacggtatactgaacagccatcttgccaagattttagcagaccttggccacactgataaaattgtcatcgcggatgccggactgccggttcctgacggcgttttgaaaattgatctttcactgaagccgggtcttccggctttccaagatacagcggcagtgctcgctgatgagatggtcatcgaaaaagtcattgctgcagctgaaataaaagcatccaatcaggagaatgcgaaatttctagaaaatcttttctctgaacaagagattgaatacctttctcacgaggagtttaagctgctgacaaaagacgcaaaggcagtcataagaacaggagaatccacaccatatgccaactgcatcctgcaggcaggtgtacttttctagaaaggaggatgaaacatgcagattgaaatgaaagacattcataaagcattcggaaaaaatcaggtgctgtcaggcgtttcctttcagctcatgcctggcgaggttcacgcattaatgggagaaaacggcgccggcaagtccacgcttatgaacattttgacaggcctgcacaaatcggatcatggtcaaatcagcataaacggaaacgaaacgtatttttccaatccaaaagaagcggaacagcatggaatagcctttatccatcaggaactgaatatctggccggaaatgaccgttcttgagaatctatttatcggtaaggagatatcctccaagctgggcgttttacaaacaagaaaaatgaaagcgctagcaaaagaacaatttgacaaactctccgtctctctttctcttgatcaagaagccggcgaatgttccgtcggacagcagcaaatgatcgaaatcgcaaaagcgcttatgacaaatgccgaggtaatcattatggatgaaccgaccgcagcgttgactgaacgtgaaatcagcaagctctttgaggtcattacagcgttaaaaaagaacggcgtctccattgtctatatttcgcatcgcatggaagaaatttttgcgatttgcgacagaattaccatcatgcgtgacggaaaaacggtagatacaacaaacatctcagaaactgattttgatgaagtcgtcaaaaaaatggtcggacgggagctgactgaacgatatccaaaacgcactccttctctcggtgacaaagtattcgaggtgaaaaatgcctccgtaaaagggagttttgaggatgtcagcttttatgttcgttccggtgagatcgtcggtgtttcaggattaatgggagccggccggacagaaatgatgagagcgctgttcggcgttgacaggctggacacgggtgagatatggatcgctgggaaaaaaacggctattaagaacccgcaggaagccgtgaaaaaaggtctcggctttattacagagaatcgcaaggatgaagggcttctgctcgacacctcaatccgcgaaaatattgccctgcccaatctgtccagcttctcaccaaagggtctcattgatcataagcgggaggctgaatttgtcgatctgttaatcaaacgcctcactatcaaaacagcatcaccggaaacgcacgcacgccatttatcaggaggaaaccagcaaaaagtggtgatagccaagtggatcggcatcggaccgaaaatgcttatcttggatgagccaaccagaggtgtggatgttggcgccaaacgagagatttatacgctgatgaatgagctgaccgaacgcggcgtcgctatcatcatggtgtcatcagagctgcctgaaattctgggaatgagcgatcggattatcgttgtccatgaaggcagaatcagcggagaaatccatgcgcgagaagcaacacaagaacgaattatgacacttgccacgggagggcggtaatatgaaaacggaacaactgcaaacagaacaaaaacggattcacttcgacggagtcatgcaaaaactcggcccgtttcttggtttatttattctcgttatcattgtatctattttaaatcccagctttcttgaaccgctgaatattttaaacctgcttcgccaggtcgccattaacggattaatcgcgttcgggatgacctttgtcattttgacaggcggcattgatctttctgttggcgctattcttgccctgtccagtgctttagttgcggggatgattgtgtccggtgtcgatccggttctcgcgatcatccttggctgtatcattggtgccgtactaggcatgatcaacggattattgattactaaaggaaaaatggcgccctttatcgccacgcttgcgaccatgactgtgtttcgcggactgacgctagtgtatacagatggaaatccgattaccggacttggcacaaactacgcttttcagatgttcggacgcggttactttttaggcattcctgtaccggcaattacgatggttcttgcctttgtcatcctttgggtgcttcttcataaaacaccattcggacgccgaacgtacgctatcggcggcaacgaaaaagccgcgctcatttcaggcatcaaagtgacgcgcgtgaaagtgatgatctattctttagccgggcttttatccgctcttggaggtgccatattgacttcccgcctgcattcggcccagccgactgcgggagaatcgtacgaacttgatgctatcgcggcagtcgtcttaggagggacaagtctttctggcggccgcggacgcattgtcggcactttgatcggggtcctgatcatcggcacacttaataacgggcttaatctgcttggcgtttcatcattttaccagctggttgtcaaagggattgttatcttaattgcggtattattagaccgcaagaagtcagcttaggagggttttcacatgaaaaaggctgtatccgtcattttaacgttatcattatttttgttaactgcctgttcgcttgagcctccccaatgggcaaagccgtcaaactcggggaacaaaaaggaattcaccattggcttgtccgtctcaacacttaataatcctttttttgtctcattaaaaaagggtatcgaaaaagaagctaaaaaacggggaatgaaagtcatcattgttgatgcacaaaatgattcatcgaaacagacgagtgacgtggaagatttaattcagcaaggtgttgatgcattattaatcaacccgactgattcttcggcgatctcaacggcagtagaatctgcaaacgcagtcggtgtgcccgtcgtaacaatcgatcgatctgccgaacaaggaaaagttgaaaccctcgttgcttccgataatgtaaaaggcggtgaaatggccgcgacgtttattgccgacaaacttggaaaaggagcaaaggtggcagagcttgaaggcgtccccggcgcatctgccacacgggaacgcggctcaggattccataacatcgcagaccaaaagctccaagttgtcacaaaacaatcagctgactttgaccgcacgaaaggcctgactgtcatggaaaacctgctgcagggacatcctgatatccaagctgtttttgctcacaacgatgaaatggcgctcggtgctctcgaggcaattaacagctcggggaaagacatattggtgatcggttttgacggcaataaagatgcgctcgcttccattaaaaacggaaagctgtcagccaccgtcgctcagcagcctgaattaatcggtaaattggctacagaagcagcagatgatattttgcacgggaaaaaagtgcaaaaaacaatatccgcgcctctcaaactagaaacacaaaaataattgtctgatgtttaggaacctgcgataacgtgaatagagatatagaatgaattatttctcttacgtgaggagaggaacggcatgaacaaaccaacaaaactattttcaacattagcacttgcggctggaatgactgcggcggctgctggcggcgctggcacgatccatgctcaacagccagaaacaacggtaagcattgatgatttatacagttatccgattgattcttatttggtatcagcagaggctctaaatgtcagaacgaaggcttccgcatcaagccaaaaagccgatacgctgcacttaggagatagcctaaagctgatttccttctcaaatgctgactgggcaaaggttcagtataaaaatggaaaaacaggatttgtatccactcattacattgttaaagcagcgacaacggtaaaaaccaaaacaaaaacaaaagtatatacatccgctgacggaaagagcattaagactcttccagcagacacaagcgtttcttttttaggctggagtaaaacgaataaaggcggttttgattttgattgggtattcgttgattacggcggtgcgacaggttatatgaaaacaaaggatttacacatgacaaaataactgagagggattccgcatttatgcggaatcccttttattatgaattgatttgtcacattcccaagatatttctcaggaaatattgtcgtatgctgtgtcgaaaccttacatgatcatcaacatttttgttcacgctaaaaagcggaggtgtaaatatggatcaatttgaagcagcatatgaatcgtataaagcccggcaaacaactgtcgatcaagaaaatgttccatctggaaaagaagaaattattgcggttagaagaaatgaggaagacaatattatcgcagtgaaaaccaatacaggaagagagctcgactatcctactgcgctgtcagaagcaaaatcaggaaaactcgctcatgttgatgtcttccataaatacgggcgtgacattttgcgaagtgaaccggacggcatcaaggaaaataatctgtctgagctgccggatttttaaacaaatacagccctgccgtatgttcgacagggctttcttttaaacaaaaggctgctgaatgtattcggctaaccgttttgcactgtgtgaaatatcctctgcagctgcataattcacgccatagaacacatatggaggcagatacttcatgccgatcagattactcgtggcctgaaatggtttcaatagctcactgatcgagtaatgatttgctccgcccgcttgatatttttccgcttcgctccctgttgatacagccagcatcagctccttgccatgcaaggcatttccttctgaaccaaaagcccagccataagtcagcacaagatcctgccattttttcaagagcggcggagagctgtaccaatatagcgggaattgaaagacaatccgatcgtattcctcgcacagctgctgttccttcgcaacatctatcgcttcatccgggtattccttataaagatcccgtactgtgatattgtcatgtttactcaattcctcagcccacgccttattaacaactgaggtctccatatgaggatgcactgccaaaaccaatattttcatcagaccacacctttactgttttgatgttattttatctaaaatcaggaaaagagccaaataaaaagaaagccctgctaaaaggggctttctttttttcttttattcagggcttccttcagttgtttcgatatctttcgcaaaatcagggttatccagattcgcattaaagaaatccgctgtgttcggaagtctgagattcatgttcattttttgagaaatcgtaaccgtgcaatcctcaagcacatagtcaaaaacgtgtccgcctgaattgcgtccttcgtcaatgaagtgcaggtgatagccagaaacggcgattccgtttgcataagctggtgtcaagaaacctacaatcgttcctctcacgttgtcgaagttgaaaatcggctgtgttttaaccgcttcaaccattggcacgtaaggtttttcttgaagttctactgttcttgtctgcacctttttaaacaatccgtcaatgcgaattgcataaaataagtttctgcttggcagcatgctgttgatctctttttcaaagtcttcgcgtgtcattttcgcatcaattttgtgcgtcatgtccggtgtaaagaacgtaaatgaacagaacggtgaacggtctccattttggaccggtgtcgcggttccgtctgagcgaagacggtaaaattcgccgtcaaacccaatcagctctccgtcaagcttgttaaaggttccgataccgaagtctccatatttcggaatctctgacagttcaaaatctccgtcatatactccgtctaatagagaagtcattgttgatacttgataaatctggctcacaggctgatctttttgaccacggctgagcacttgaatgttgctttctcgtttcatatttcccttcactccttttatttagtgctgttcataaaacagtgtcgtgatgcgcagagtgctagagagcttttgttttcataagttccccgaattctttcggaagcttgtcacttgctaaattaatgttatcactgtagtcaaccgggacatcgatgatgacaggaccttcagcgttcatgccttgacgcagaacatctgccagctggtctggtgattctacgcgcaagccagttgctccgaagctttccgcatatttcacgatatcgatatttccgaaatcgaccgcagatgtacggttatattttttcaattgctggaatgcaaccatgtcatatgtgctgtcgttccatacaatgtgtacaattggtgcttttagtcgaactgctgtctctaattccattgctgagaataagaaaccgccgtcaccagagacagaaaccactttttctcccggtttcaccaatgaagcgccgattgcccaaggaagcgcaacgccgagtgtttgcataccgttactgatcattaatgttaacggctcgtagctgcggaaataacgtgacatccaaatggcgtgcgaaccgatatcgcaagttactgtaacatgatcatcgactgcattacgcaactctttaacgatttcaagagggtgcgctctgtctgatttccaatctgcaggcacctgctcaccttcatgcatatattgttttaaatcagaaaggattttctgctcacgctctgcaaattctactttcacagcatcgtgttcgatatgattgatcgtggacggaatgtcaccgatcaattcaagatcaggctggtaagcatgatcaatgtcagcgataatctcgtctaaatggataattgtccggtctccattgacattccagaatttcggatcatattcaatcgggtcatagccgatcgtcagaacaacatctgcctgctctagcagtaaatcgccaggctggttgcggaacaaaccgatacggccaaaatactgatcctctaaatctctagaaagggtaccggcagcttgatatgtttcaacaaatggaagctgaacctttttcaaaagcttgcgaaccgctttaattgcttccggtcttccgcctttcatgccgaccaaaacgacaggaagttttgctgtttggatttttgctatggccgcactgattgcatcatctgctgcaggaccgagttttggcgctgcaacagcacgcacgtttttcgtatttgtgacttcattcacaacatcttgcggaaagctcacaaaagcggccccagcctgccctgctgacgctattctaaatgcatttgtaacagcttccggtatattttttacatcttgaacttctacactgtattttgtaatcggctggaatagcgccgcattatccaaagattgatgtgtccgttttaaacgatctgcacggatcacgtttccagcaagcgcaacgacagggtctccttcagtgttcgctgtcagcagacctgttgccaagttagaggcacccggtcctgatgtgactaacacgactcccggttttccagttaaacggccgactgcttgggccatgaatgctgcgttttgttcgtgccgggcaacgataatttcaggtcctttatcttgtaaagcgtcaaataccgcatcaatttttgcacctggaatgccaaatacatgtgtgacaccttgctccactaagcaatcaacaacaagctccgcccctctgtttttcacaagggatttttgttcttttgttgcttttgtcaacaccctcactccttattatgcattttaaacgtaaaattttaaatatcttgtgataagtttcactatacactctttggaaattgacctccaatatcgattcgccttatgattaatatgtaatacgaattattaacctatggaaaggaatgcatattgaatggagcttcgccatcttcaatactttatcgcagtagccgaagagcttcatttcggaaaggctgcccggcggctgaacatgacgcagcctcctctcagccagcagatcaaacagctggaggaagaagtcggagttacgcttctgaaaaggacaaaacgatttgtcgagcttaccgcagcaggagaaatctttttaaatcattgccgcatggcattgatgcaaatcggacaaggaattgaactggcacagcggacggcccgcggcgagcaaggccttctcgtaatcggttttgtcggatcagctacatatgaatttctgccgccgattgtccgggaatatcgtaaaaaattcccatctgtgaaaatagaactgcgtgaaatatcctcgtctaggcagcaggaggagctactaaagggcaacattgatattggtatacttcatcctcccttacagcatacagctttacatatcgaaaccgcccaaagcagcccttgtgttttagctttgcctaagcaacacccattgacttctaaggaatcaattacgattgaggatttaagagatgaaccaattattactgttgctaaagaagcatggcctactctatacatggattttattcagttctgtgaacaagcgggcttcagacccaacattgtccaggaagccacagaatatcaaatggtgattggtttagtcagtgccggaattggtatgacatttgttccttcctcagccaaaaaattatttaatttggatgttacttatcgaaaaatggaccaaatacagcttaatgcagaatgggttatcgcttaccgcaaagacaatcataatccgcttataaagcattttattcatatttcaaattgtcagcagacaagaactaaagagagtgatgcaggtacatgaacaatacttgcaatctcttttttcttttgggattcttatggaatttttattaatttaatataatcgcttagtacaactttatatcagtatacgtatacatacagtacaaatagttggcaaggacatcagtaagcgcaggacattagtttgattttaaaaatgaaagatagagaggtgaagtaaattattgagttcaccggcatattcacattgctcgcttttttcgtaacaatgatttttattttctggagaccaaaaggactaaatgaagctatccccgccacatttggcgctttaatggttttattgtgcggaagtgtgtcattggcagacttaggggaaatcggaacaaaagtcacgggtgcatcggttacaatccttgccactatgattatggccattgcactagaaagctttggtttcttttattgggtggctgcaaaactgctccaacaatccaagggttcaggcatcaagcttttttggctaaccaatttgctctgctttctcatgaccattttcctgaataatgatgggagcattttgatcacaactccaatccttttgcttgtactaaaatatttaggtttaaaaaaacatcaaaaagccccatatttattaagcggtgttttaatagccacagcctctagcgcaccgattggcgtaagtaatattgttaatttaatttctctcaaaatcattggaatggatctatatcttcacaccgccatgatgtttgtccctagtatgatgggactcatttttatgacttgtctactgtttatgttcttttataaacgtcttcccaagaacctgccagatataccgggccattttcagtctctgcggcatagaaggtaccatcctcttcattcgccatcagctcctttaccagaacgaaatcaaacaaaaatcatgttgtttgtgcttgcatttgtttttctcgtcagaatgagtctatttgcagcatcatataccggtatttctgttcctctagtcgctgtcatcggatcttttatcctgttgagctggagatggatttatttcaaaacctccccaagagacttgttatataaatcgccttggcacatttttatattcgcttttactatgtatgtcttaatttatggtctgcataatattggattcacagagttacttgtgaattattttgaacctgtggtttctggaagcctcgcccatgcaactttcgcatcaggtatctctacttcagttttttctaatctctttaacaaccatccagcgttaatgatcagtacttttaccttaactgaaatgaccctgaatccttcaacaacaaaaatcatctacttggccaatattatcggcagtgatatcggttcattattattacctatgggaaccttagcaacgcttatttggatgcatatattaaaacagtatgatgaaagtatttcatggggcgaatatataaaaacgaccattatcatcattccgctgactgttctttttacgttaacatgtttatatttttggatcagttggttatttctttagcacagtatgaaacgaaaaactgccttctgctattcaagagggcagttttgcatacactagggaagatgcattgtctttagatgatttaacttccaaatgattggctctccatttgcgttaataagctcaatgatattattagagacatcctttaatagaccaactttttctggcacctctcccatatcaaatatgaccaattcaccaatattttttttgatctgctcctcaaaattacgcacaagaggaactttggaaggcatgacaggcaattgtgagttgtcaagagtgtacggtgtttgttcagttgaataaggggtaaaccattttaaatgatgcatagatataaaaagtattttaaatacaggtgagaaaaatacaatataatcgtttaaaacatttgtaacatacccatggatcgatcgacccccagttacataaacttcaataaactggcctttgaccttgtttaatgtatttctatatgaaaaagcttgagtttctgcctctatggatggatcttccggattgatcaaaaatggcttctcagtactggtcattattttcgccttgtttatttgatgaagatgcaacaagggaatataaagataattgcagccatcaaaaataacaaaaatatcctgtccgatatctatgagggtgccgacaaaccttgtatctcctgaaatgacaacctcaacatctgtgttaaggaattgattcaaacctttcacgattctcctcctttaactgaaaaagggcatcacttaatctgatgctcctccattatctattaaaatttacgtttccagtgatagtctatcgttctgacaatcgtttcatagctataatcatccttttgtttttctgaacttttgaaggaacttgaataacctggtgatcttgatgattgataatctgatgatcttggtgatcgtttagatgattttgatgattgataatctgaagattttaatgatcgtttagatgattttgaagaactttttgaacgtgacgaacggccagatttggatgattgataatccgaagattttagtgatcgtttagatgattttgaagaactttttgaacgtgacgaacgaccagatttggatgattgataatctgaagattttagtgatcgtttagatgattttgatgagctatatgattttgaagaaatgaacgaattgctgtccttatcattattgtcttcctggctttgttcatttttttgatcctcttttttgtacgacccttttggtcctaagctgatgctttttatgtgaaaaggatagatgcgaagcacctcttgatttttcactatagtataatggccgtcggcattatctacaaggataccctcaatggcttccggacctccacgattaattgaaacccatttatgagtcagactcttaaaaacctcgcttaaatcatcagcttccaaaactccaactggcgtctgctcttctattttcaaatcaggctcgtgtttacttatacttttgatgtgatggatattaaaatacactaccccatcctcatttgtgtttaacgcagcgtaatcatctcccagccagaccaatcttccttttttagattccggacccccttggttaaattgaactgattggtttattaaatgtccgattaagctatgaaaatcatcagcatcgagcatttcctcagtctcaattgtcgtggtgctattattggtatcctcagtaatacttttcacatgctccaactgataataaattatttttttttcagcttgtaaagctatataatctgattttacagctgttaattttccttttttagattccggacctccacgatatacagtaacaattttatctttcattgagtgcaaaaagttataatacgatatttcattatttgaatgatatttcattctcctcttgctcattcaaattcctcctagtcacttatacatagatgataaacatactgcatatatacgtgtcacatttatttgttgaactaattcaatagcctaattgtcgctttttccgcgaatacccattttcacgcattcataaaatacttaaatgatctttgaggtattgtgaacggtttttaatatactcgcagatcacatccggctcacggtcaaaacgctcaacatcattctttttatatgggtccatcaagataaaaggcctaatccgttcatacatcgccatgattttcggttccatatattctattgtaaaaagagattggagcgttttttctaacaggcgcttgtaggacttgcgaaactcggattcatccaatatccgggcggttagtgtattaaatccttgaattcttacataatcggcagccatccgctctccatggatatccctgccccaagtcgcatcataatcccaaggaatcacctcaaataatccggtttccccgcttctgtataatgcgtagttgtggacaaacccgtcatagtttgaggtgaatacaataccggcaagccagcgcaaatacttgtcgacatccacgtgttttgtcacttctgacttaaactgagctttagggaccgtattaattttaaaaatcatatcctgtaaataaaaatcatcctcctcagtccctgttttcttttcatatccaagctccagcgatgttttcgtttccctttctaaatcgctcatcagagaaaagttggcatcatcatccaccgcataaaaaatcgcgccatcagccagcttccttttcgccaaataatattcatctacggattcaagttcaagataaaccccttcattcttcccattcatctttacaaacacaaactctgcctttggagacagtgtccctagctccgagaaaaaatccagagacaatttgtttctcatcaaggaaggatctttatactccgcatttaagtgaatctctcgcgcgccgcggaatgttttcggctgataaaaggaaatatggtatgacttctttttgaagtctctgatatgtgatccccgataagcaatatcaatatccagccttttttgatttaccttcatcacagctggcaccggatcatcgtcccatatatccttttttaattcacgcaagtcttttggatgaacaaacagctgataaagcggtaaattggattgattcttcatccataatcctccttacaaattttaggcttttatttttataagatctcagcggaacacttatacactttttaaaaccgcgcgtactatgagggtagtaaggatcttcatccttaacatatttttaaaaggaggatttcaaattgggccactattcccattctgacatcgaagaagcggtgaaatccgcaaaaaaagaaggtttaaaggattatttataccaagagcctcatggaaaaaaacgcagtcataaaaagtcgcaccgcactcacaaaaaatctcgcagccataaaaaatcatactgctctcacaaaaaatctcgcagtcacaaaaaatcattctgttctcacaaaaaatctcgcagccacaaaaaatcatactgctctcacaagaaatcacgcagccacaaaaaatcgtaccgttctcacaaaaaatctcgcagctataaaaaatcttaccgttcttacaaaaaatctcgcagctataaaaaatcttgccgttcttacaaaaaatcgcgcagctacaaaaagtcatactgttctcacaagaaaaaatctcgcagctataaaaagtcatgccgcacacacaaaaaatcttatcgttcccataagaaatactacaaaaaaccgtaccaccactgcgacgactacaaaagacacgatgattatgacagcaaaaaagaatactggaaagacggcaattgctgggtagtcaaaaagaaatacaaataatctaagttttcattgtttcaataggctgccggcggaggtacggaagcctatttttttatttgccctgtattagatatatgtcatgacataacatatgcaacccgcatcatttggtttcctttaaaccatttcgttataatcaaggtatcctaacgataaaggcggttgttgctatgtacatatttcaagctgatcagcttagtgccaaagacacatacaagctattgtcaggtaccgttattccccgccccattgcatttgtgacaacactttcttcaggaggagcggtcaatgccgcgcctttcagtttttataacgtcgtcagctcagatcctccgcttctcagtatttctgttaacaggacggaaggacgccaaaaagatacagcgcgaaacgcagtggagaacggagaatttgtcgttcatgtcagtgatgaagccatcattgaagatatcaatgaaacagctgcaagcttaaggccggatgaaagcgagcttacacgcacctcgcttcatcctgttgaaagcaaagctgtttcagttcccggcattaaggaagcccgcgttcgctttgagtgcaaattagagcggcatattacctttgacaatgatcaaggcatcactacagcagatctgctcatcggaagagttgtctgcttccacctagatgaaaaggtgtatgatgcagaaaagggatatattttaacggatgaattaaagcctgcctcacgattggcgggaaatcactatgccaagctgggggaagaattcacactgattcgtcccagctgaagagaaggactatttaaatagaagaaactagtcaaaaagaccttatgattacaaaatatcgcctgtaaataactgaaaaaatatcaaaaaaaagaacacccagagcaagctcggggtgttcttttatgaaacgtttttcctttttcttcgtataaaggtagattaggaggaattggaatgacaaacttttggattttaatgctgatcgctattaccatcagtctcgcctctcaattttttataaagaaaaaatacggtattgataaatccggctggcgatataagcatgtcagcaatacacacaaatggatcgaaatcactttacttattttgtttgtgttttcactctccttttttccagttgaatatttgcttcttttattttttattgtgattgactcaatacgaatttttatggagtggcattatagacctgaagataaacagtatatgtaccacattgtagaggtctcacttatgtttatgcttttgatttatatttgtaccctatagttatttaaatccccacagccgctccgtctccccgaggatcggctccgccttggagaaagccttcttcatcaactttgattgcagccgcttgtcccatcagcggatcatagtcaccgacaacctccacgagatgcccgctgtctttcagtttttggattgttttgtctgtgaatctgccctcgactctgagaccttcgtattcctctccccacgttctgccccatacccagcgcggttcgctgattgcttgctgtggatgcattccgtagtccagcattcgggtaatgatggccgtctgagtctgcggctggccttcgccgccttgtgtgccgtacagaatttttggctttccgcttttacagaccatagccggcatcaacgtatggaaggtgcgctttctcggttcaagcgtgttgacatgattttcatccagtgagaaaaatgatccgcggttttgcagtaatatgcctgtatcaccggctgtgactgccgagccaaattcaaagtacaggctttgaatgaatgacactgcgttgccatccgcatcaattacggccgcatatgccgtatcacttcccaccggcctgctttctgccggttctgccagaatgccgatttctcccgccaatcgtttcgcataatttttatccaaaagcctttcaagcggaatgtcagcaaacgcagggtcagtcaaaaaggcattccgatctacaaaactctttttcagcgcctccacaagcacatgataatactcaaatgaaccgtgctcgatttgggtgaaatcatagttttccaaaatgttcagtgttaataaaccggtaaatccctgagaattcggcggcgcctgatacacactgtatcctcgataatcacttgatacaggctctgcccactcaccccgatgcgctttaaaatcatcgattgtcatgtaactgccgttattctgtaaatgtgagacaattcgctgagcgagatctccttcataaaatgcgcttcttcctttttcagtaatcaagttcagactgtctgcaagctctttttgcacaaaccgctctcccgggacaggcgctttgccccttctcgtgaagatgtcagccgtgtaaggcgtggaagccagcagttcaatattcttttctgtgtgacgacactgatcagctgatacaggaaacccattttgggcataatcgcgtgcgggctccaatacatctgcaagagacagacgcccgtactccttcaggaccgcatcccagctatcaaccattcccggcacggtaatggcactgtcaattccccgcagcggaatcgcgctttttcccttatatacatctctcgttacgttttttcctgaacggccgctgccattgtagacttttactgcctttgtttcctggtgaaaggtcagccaaaaggaatccccgccaagtccggtcatatgcgggtacacaaccgcaagacaagcactcaccgcaacagcggcgtcaaacgcgttgccttccttatccagtatgcggtttccggcttgagaagcgaggtaatgcggactgacgaccatttgctttgtaccgatgacagatctgttcatcacaagtccccttttttaagaaattttcttcagtatagggagcctgatttttcacatctactgatccggcagaaaaactgacgaactttcttcttttcgcaaataacaagatattttcgcattcatttcgaaaacaaatgaaaaattattatttcgatacgtaacttttatgataaaatgattgctaaaaggctacgaaagcaggtggagcaattgagtcatgaatatcaaatccccaaccttgtacttgatgagactgataaacaaattctcacgattttgcatgaagaaggcagaatttcttatacggatcttggcaaaagagtcgatttgtcacgggtcgccgtccaggcccgtatcaaccaattaattgaagccggtgttattgaaaaattcaccgctgtcatcaatcccgctaaaatcggcattcatgtttccgtgtttttcaatgtcgaggtagaaccgcaatttttagaagaggtcgctcttaagcttgaggaagagcctgcggtcaccagcctttatcacatgacaggcccgagcaagctgcatatgcatgggatctttgccaacgatcaagaaatggaagaattcttaacaaaacggctgtatccattgcgaggcgtcgtcagtgttgattgccagatgctgatcaaacgatacaaaagccgtatgggaatgaagctgtaaaggagagaaacgaatgaaaaaccatccttatcgggatatgacggccgcaatggttcgcaccggcatattagggttcggcggcggaccttccgtgattccgctgatccgccatgaagcggtcaataaatataaatggattgacgatgatgaattcggagaaatattagcaatcgctaatgcgcttcccggaccgattgccaccaaaatggctgcttatctgggctttaagctaaaaggcacattaggtgcagttgtggcgaccctcgcccacattctgcctacatgtcttgcgatggtgggcttgtttgcggctgtaaatgtgttaagccattcagcaattgttgcaggtatgatcggtgccgtcacgccggtaattgcggtaatgctcggaatcatggcgtacgagtttggccaaaaagcgcttaaaggtttcggctgggttaccggcatcctgttttttatcatcgcttttatcggcctgcaaactttacagattaatcccggcctggtcattatcattttcttagcgtacggggcgtttcattttaaactgaaagacaaaatcacaaataaacattcaaaagataaaggaatgtcagcctcatgatatcgatctatttatttatggcgttttttatcgcaaacctactgggatatggcggcggacctgcgtctatcccgctaatgtttgaagaagttgtaaacagatacagctggctctcaaacgatcaattctcaaacatgctcgcacttgcgaacgctttgccgggcccgatcgccacgaaaatcgctgcgtatgtcggctacagcgcaggcgggtggcccggcttcctaattgccctgatcgcaaccgtcgtaccgtcggcgctcgcattgatcgtcctgctgcgcatcatccagcgcttccgccaatcacctgtcatcaaaggcatgacgctgtccgtccagcctgtcatcgcggtcatgatgctcattcttacctggcaaatcggcgcagacggcatcaaagcgatcggctggatccaatcgatcgtgattgcgggaatttcgctccttgccatgacaaaattcaaaatgcatccggcatttttgattatcgcggcgtttttatatgggggccttgtgatccctcatttatagaaaaaagcacctggacaggtgcttttttattttggcccagaaatgccgtttgatatgacagctgtttcttctcctgcgtcactcttgatgatgtgcttgacttgcagcgtggttcctgccattctcacagattgcttcaactcggacgaattggtttcaacttgtatccaaacaggaggctggaccttccaaaataaatagagtgcaagaatcagcaagccagcaatgaccgacagcaaaaacttcatatcgcatcgcttcttttcagtaagcggcccgcagcggacagcgcctgatgatcacgaagaatatcgcctggacgattgccttctcccagcacatagcctttaaaggacattcccataaaatgaaaaatatgttcgaattgctgaatcagcggcagcccttttatttttggattgtctccgcccactgctattacatatgcctgtttcactgacatttgctgtttaaaatcaggaaatctcggatctctcaacgtctgtgaccagcgatcaataaacagctttaatgtccctgacatgccaaaccaataaattggggtggcgaatacaagaatatggcactgcaatatccgttcaatgatagaatcgtagtcatcttgaacaggacgaaagccgccttgggcgtgacgcagatcttcaattggctgaattcgatatttctgcaaataaatgtgctccgcatcgaatccttgaacagccttctccgcaagaacatccgtatttccgccagaccgagttccgccgttaataaccgcaattttcatgatgcatctgctcctttgtttacgaatgattttcttcatcttataatggattcatctatcaatacagatgattatttcgattaatccaatcgctaaaaccgatttagaaaggaagagaacaagtggaattgaagcagctgatcacctttattacggcggcagaacatgtaaacttcaccctaaccgccaaaatgcttaattatgcacaatcaagcgttacctctcagatcaaatcacttgaagaagaaattgggacgcctttatttgaacggctcggcaagcggcttatcttgacagaagcaggaaaaacgttcaaatcttatgcacagaagatcattgcgttaacagaagaagcgaaaatggccgcaaatcaagtaagagaaacaaccggaaccttaaaaatcggggcgacagaaagccagtgcacataccgcctgccccctatcataaaagaatttaaacaggcttttccccaagtaaagctcatattcaaaccatatatctccaatgaacaagcgaaagaacagctcttacagggccagcttgatatcaccttcatcttggatgtaaaccggatggaagacgcactgcacgttgaatctttgattcaggatgagatcaaaatggtggctgctaatgaccatccttttcctgcggatttaccagtaacattgaaggatcttcaaaacgaaactcttctgctgacagaggacggctgctcgtaccgcacgctctttgagaacaatttgcatgactccggtgtctatcctaacaaattggaattcgtcagcatagaagccatcaaacaatgcgtgatggccggacttgggattggaatcttgcctgaaatgacagtaaaagatgatattgcagcaggccggatgaaagaactcaattggcagagcgattgccccgttttcactcaattagcatggcataaggacaaatggatgtctgcgccattaaaggcttttatcgatttgacacggaaaacattcaaataaaacctctccacaaggacgacaaggtttttgagaccaggaaagcacacacatacaaaaaaacacttgatgacttagagccccaagtgttacatgtgatttttctgataaaacgttcgcaaaacatgcgtttcaaggtcagccaggcggacagggattggcaatctgctttcttgattgatcaagctcatcgtgatctgatagctgctgtctaaatcaatataattaccgcaagacaagaaaataggcttcacgtccccccgcgttcgcagcgcccggccatatacctcgccgtcaatgagaatatcggtgtatgcaccgacttcattttcaggcatcacgaaatcatagcctttgattttgagataggttttcgcaatcccaatcgtcggcttgcccagaaaaaaagccgcatgggtggcaacgcccatatgattgtaatgcagatatccgttgccatcaaacaagaagacatccggctccgtctccagctttttcgccgcctcgatgatcaaaggcagctcgcgaaacgcaagaaaaccggaaacatacggcacgctgattctccccatgctgtgcactttttcaatgacttcttttgtatcagcgtcaatcacgataatactgcacactccgtatggttctccgttctgctcccaataggcgagatcgacgcctgcgcaggtgttgatggagttgggatggatcgtgtgggataggttgatacgatttctaagggattgttgtgtttgaacaaaatccgattcatcttttagatgaaaatcgtgtatttgatgtatttccattttacttgtttccctctcttcgcgctcaattgtcctgcatgtcgattctagcaatgacaccaaattatatcattgaaaaaagcagatagtataatctgcttttttattactattcatttttcatttctttcataaaaatataatccaattgtttaattaattctttaagttcagtacacataatatcctctaaaggattttcccaatcttcgttttttatcagttcaatcccatagcttccggctggatcaccttctgggtaccaccctacgtcaagcagcaaattttttgtcttatgagaaatctgcaggagatcttgattaaagtcaaataaccaagcatcgtcatttgcctctagcgtcttaggatcagtatcctttaatgtaatataatcaacagtccaaccagccggtatctttagccttaaaaaattgggaatctgttggcttagtggctgtaaaccctctaaaaccccgcttcccacactccagatttgatattctaactcttctaataattgttctatctcattaaaagactcatcttcataaatcttatctgtttttaagccagctactttgatatggtattgattattttcataacttaccttaataaaggccttacgtttttcattttgtagtattagtaattcacatttttcttgcattcttttttctgaacataaattgttcagtactacagaccagccattacagatttttaatggctgcagttgagaaatatggtctctttccatcccgcttctccttgcactccatattgttatactatctataaaaaagcatgccgatgacaacacggcatgtttttaactatagcaattctaatacatcagagtaaacaaggcatctcctaatgttaatctcctgttgaaaggctgtatatgcggcaattcactccactcatacacagtatcgtagtaatcatacaaataactgagttcaataaaccctttctcttgcattattttattaatatagttcgttccctgaatgaattctaaagattcagcggtgcctacaatatcataaacgccatcgattaaatcgtgtcttagggaataactataatctaatacataaacaggaaccaatttagatactttcatattgatttgctgttctaaatgaaaaccattttccccagaaagatcttgcaaatggatatcaatttctcctgaaggattgtttaaatctctaacttcaatttttttcaaaccttttatttgattaaattcatcaggtacttttattttctctgcgcatttgttcttgtaccattcgcctaattccctattcacaaatagacgataaagcaactcaccaatttcaggatattcattaataaacctgattccatgttccataaatagtaaccattccatcctttaatcaagaaaatctaaacttcattccaccaagtagttgttacttgttttaaatgatattcaatatataaaatcacttttttatagtcatctgatgaaaattctttaataggatcttcccaatcattatctttgactagtaaaaccagataattaccttcaggagaaatgtcaggaacccagcctaaatcaagcgttattgaggattgttcatgataaagctgcaacaaactgtctgtgaacaaaaaccaggaatcatcattcggttctaatgttcttggatctatttcaacaaaatgattataatttactttccaaccttgtgttattcttaagggatgtatattagcttttggaacatctaatttaacatgttttctcatttatataacctctttagagagccgttattcttaaagtctgtttttagataacttgtcaaccaactatttgagtgggagacctgaaaggtgaaaatgtagattatgaataatatttacttagctgtacgaacttcattttacaaggctgccccttgcatctatattcatcttactaattatcttatagatcagtttcaatgcaaaaattttaagtttaaaaaacctcgagaggcaagcgccaatcgagggaaggttagtttttttctacttacttgttaaaggattaaaactgatattcttccagaaaaacgttatgagaacattagctgcatctcatattatctttcctctctgcacaagtgattatattcaccaaatttagggaaatcatcccagttgctcttaaggttgtcgctagtctcacgctcttcgaccgaaccggtcttgaaatctgtcttctccattgctatatgaccatcttcgcgaaagcctaaaatcaaactgctaacttcattatcagttgcatcatcatattcccaatacattgctgttcttaagaagattttaccatcacttataacttcaaaatcataattcagatacttacgagtcaagtcatcataaaaacccactgaaacccatttatttgttacatttacaacatatttaggtttttcgccttcggttaataccgcagtatatggttcatgtttttggtgatgtaagtatgcggtacaatcatcaagaatattccaaggctgtttttttatgtccgaccattcatcacaataataaactttcatagtcaattatacaccttcccatttatatccctaataataatcctattttttgttgcttcatcaagaattttttgtggaatagctttattttgaacaggtacttctaatatcaattcacctttcagtcatccgcctttaagagcttttggattaaaaggaccatttgatattttagaccctgaagaatattttttagtaatctcgttcaagtaactcagtgctgtcttttcttgaacgtcactaagttgagtatacttcctggaaactatctccttatttggagaatatgaatcaactacgtactttttgccgcctgcttcttttgcttctagctctacttcattataagggtaacgggggcgattttccttattgaaattatttcctgcttcccaccgttctttaagccaagacggtaatggattcttattagatgacttccccgtacccttaatacctttaccactactaaccatcttcacaatcccaagatccttaacagccgtcttttccacatcgacacgtactgtcgggattccgaatgtaaagccatccggagttacagggcgttctgcgtacacgtggacgtttgttgggactttgaattgttttactttctctagtgttttgtttgctttttggacttttgaatgggttgcaagcgggatgcctttatcaatatgtttcgccagtgcaccggctccaaccaaactcagcacagcttccagcgccccctgcttccgcttctcctcagacactttgtttccaaacatatcccgtcccgtgacggcttctgagaatccgtttgacgcaacaaggccgtatgcacccatttctgtcattttgagaatgtctaaggatttgcctgttttgtaggcgtctaaagcgtgttcagccgcgatagcagcttttccggttttgtagatggcttttccgcctttgaaggcgcggcctgcccagccgacgactggtataaatcccacggctgccatggtgccgactgtgacgcgttcaaagcctatacttatttacgctatataaaacagtggacaacaaactaataaaaaaaccttgaaaggcttcagtgccaatcaaggtagaaaatcaaaccaactcgaagcgtttatttgtttttaataatgccttaagattttttaacaatactattaattccttcaaatataatatctctcataacttcattattactgttataatttctttcatttcttattttattaaaaacctgctttataaccccatcaatcattattgttaatccttctatatcttcttcactaccctcctttttaaaactttcatttattattaccaagctatcatcttttgacattttattttctcctttactctctttctttctcattaaaaactttgtctatataatttacttcatcaaaaatccagtatctatcctcttcaggaatataactagtaaagtcttcccgaacccctgtccaattattaggaacataattttcaaaaggtaataactcaggatacagcgaaagaagcattttttgattaaagtctatatataatgatggccttaattctagaatagtactttcataatcctgatgttcaactaacttctttaattctgaagacgggataatatagtcagtatattcttttaaataaagacgataattatcttcatttacaactgaaatgttatttcttagagaaagagcaaagtccatatcaaaactaaacccgtttttttcataggcttctttatatttcatgatatctagtatccaaacatctctttctgttagataccatgagaattgagaagaagtctttaccccgactattatattttgggcatactccggttttaataacaacgaaaacaccactttctcattctatttttttggctgaatgcccatattcctctaaccactctatccatggttccgccggaagttcataactaactcccggtgtcgtaggatcaacaagctttggagcagttctcccctggttacgagggtttttagtatatccatactgatcaattactgtctccttgattaaatcatcaatctctttaggtaccttaaattctacaatttctccgcctggtcttgctacatctcgataatatttagcgtgttctaaattgtaagcacttatgtttaaatcagcatttttaataggaatagcaatgcttccatcactatttactttaattctatactgacttgttttatttcccgctcctcctccttgaactctgtaataacttactgattgttcgacaggatcgacagattttttacttgattgtaacttatcattatttactttcttcgtatataattgtttcttctctggctttaagtcaaatgtatggccagtcgaagtaacaatctgttctttatttatatgaccactttgcttaattttagaaaaagaataactcttatcaagatttcttcccatcgatagcgtattgtcaaccgacttcgccaatgcaccagcaccaaccaaactcaatgccgcttccagcgcacccgttttccgcttctcttcagacactttgtttccaaacatatcccgtcccgtgacggcttctgagaatccgtttgacgcaacaaggccgtatgcgcccatttctgtcattttgagaatgtctaaggatttgcctgttttgtaggcatctaaagcgtgttcagccgcgatagcagcttttccggttttgtagatggcttttccgcctttgaaggcgcggcctgcccagccgacgactggtataaatccggctgcggccatagctcctgctgtcacacgttctgcggtggagagtttttctccggtaaccggatcaacgccttcagttgctcttttataatcataatagccagtgacttctccagtaaagttgcaaactccatcccatgttttttcgtaccatggtttgtttgcttcttcctcggctttttcctggagacgtcttgcttctgcttgctgggcttttgcatcaatataggttgttccttgattttctacttcaatgacgcttttgtagacttcattgctgtggaaggcttttttgtcatagtacataggggatgcgctcttcccattgctggtggcctgcatgagaacagaatatttggtgagcactgcgttgtccagagattctaaattttgatattcagtggtcagggattcatcaagcttatcgacagctgtgatcgtgtcacgtctgactttttgggcatcgcccatcttatctgcatactcgtcaagcgtgtacatgtcgaggtcaataatatcgctgatgcctgacaaaatagaatcgatttcttctttatgagcggagactatctctgaggctttcaggtctccattgggcagctcatgatccaaaaatgaagtttccacatatgaatcattcagttcttgatctttaatatcgcctgaaatgccgtttaaaaatgcaatttgagcagagacaagcgtcagccagctgtcgacgatttccgcctgtccctgaaagaaatctttaatattgtccgcgccttttcctttaaaattatcgcctaaatctgcaactccctgaaacgcttttttcagcgtattcagctgctcttcaagcgtctcatattgcttttttctgctcttcgcttcttcgattaaagattttgattcaaatactttactcatcgcactgccctttctgttctattttaccgctatcgcctcgtcctgctctttaagtgaatctacgttatcctttgtatcctcgatatttttctgtaccgcttttttgtaatctccgagcatggttttgatgttctcctcacgctcatgatattttttcgtataatcgagtttattttttccattggaccccgcggcgccgattgatacgtcagcaagcgcatctttgacagactctaatgttttgattacagcatcgtatttcaatttaatttctgacataaaaaagatcaccacaatttaatagatttaatttgattaacagcatcctccaagaattcttcacccttagcaagagtatgaccagcaaaattcgctagctttaattctttgtcatagagaaatttcatagattccaactgaataatctccatctgaatcgaagccatatactcgttatatttatcattcacaatcttagatgcttccgatttcgcctcttctcttcccttgtcgaaatcatcggcttttgttcccgtccaatgcttgcccaattctggttttacaatttctttgatttcagtgattgcctcttcttgcagtgtgtctatgtccttttttgcttttttcagcttttcgatcttgtcttccacgtcggaaatttttccgttgagcgaacttttgatatccgccagcatactttcataacccatctgaatcacctcttaatactcaaaaagtcgtatggaggggctgatgaagatagacttttccatactttatttccatatattatattttaaaatagccagaaggcggcttaaatagggtaaatggcttaatttaggcatataacgctcttgaaatgtaggtatttgatcttgtttttgttcgttatacagctaatgaaaacgttttttaaaatgaaatcacctaaagtcatagttataaaggcacttgaaagaggcagatgttgttgatctgcctcttacggcgctgagcttattgttcatgtttatgttcttcatcaggtcggccacgtctgattttgtctttggcttctattattccccgcttctgaccctttggatcaaaagcttgtattagctgcagtcccagttgtacagaacgtttgaaaagtcttttttccttagatcgtcaggtgtgatgaaaaaattggcgatgccgacgtctccccacattgaatcgatatcatcgtctgaatcaatttgtaaaagcatgatggtgtgttctttatatgcgtattcccgtggatcatgctgggtaaaagaagcgtatccgccgattttatggccaaatccgttttcagccagttcattataaatgtcttcttcatcctcgccgaactgaccaaagaactccattgtttccatgcccgtatactgctcaaattgaaaatctgtaggcagcacccattccgaagatttcacaggctcgactgccgcttctgataaaatcggaaaatcacattcgcctgtgccaataaatgaaaaatcagaaacaaggtcgtcttcgttttctatgatattttcaaaatagatcactctgaaattcttttgttcacatcgatcgtcaaaattcaatccatagacgtcatcatgaagagaaatgtagaactgcaggatacctgaagaaggatagccgtcaagctggggaatgtgcgagaaattaatctgcgccagaagcttcatcggctgtccatattcgtcagtcggatatgtttcatgcttggggaaatagggatcaccggcaattttgctgtcatatcgtcctgttttcccttttctcacattcagtttcacgtattctttcgctgatttctccagcaagtcgcggtacggtctcattttttcgggtagatgattcatcagattctctccttttccggcatctccaaggttttattttctggttttcttcgtttcttctaatgtttttcaaacgattgtttaaagaagccctacttctgtataattttccaaacaatagttaaatagtagcaaatgtattcagcaccccgcaatagatgaaaaaaagactggtgcgcaaccagcctttctttttcaactattgaattgcacctgacggaacaaccgccttccgtccgacagaataatactccactcctgcagccaaagcctcatccaatgtgtagcagtttctgccgtcaaatatgagcggcgtttccatcaaatcctgataagccgctaacgggaattgtttaatgtcagcccagtcggttaaaatcatgacggcgtcagaccctttgacagcttcctcgatcgtctctttatattcaacagcttgcgggagaacatgctttgcatggctaactgcaatgggatcgtaggctctgatacgggcgtcgagcgcagcgagacggtctgcaataacaattgacggcgcttctctcatatcgtcggtattcggtttaaatgacaggcctaaaagggcaatcgtttttcccgtcaccccgccgagcctgttcagcgctttatcaaccagcatcgcctgctgattgttgttgactttgataaccgatttcagcagttcaaaatcatgctcgacattgccggcaatttgcacgagggcgtttgtgtcctttggaaaacaagagccgccgtagcctatgcccgcttttaaaaactggctcccgatccgcttatcctgtcccatcccgtatgcgactgcttcaatatcggcgccgaccttttcacatatattcgaaatttcgtttataaaactgatcttagtggccagaaaagcatttgaggcatatttgatcatctcggcgcttctgatatccgtttggtatatcgggatttgaaacggacggaagagctcctccagcgtatttgctgttttctcatcggccgtcccgatcacgatcctgtcaccatgaaaggtatcatagatcgccgacccctcacgcaaaaattccggattggatgcaaccgaaatactgacaggctccgctagatgttcagtgatcagtccattaatcaaatcgtttgtcccaacgggcactgtgcttttcgttaccacgactgtatctcgtttgacatgctttgcgatgcgtttggccgcatctgtaatttgctccagattggcgtgcccgtcgcttttctgcggtgtgccgaccgctataaaaatgatgtctgcctgtgccaagcctttctcatagctcgtttcaaagttcagccgtccatcagctgtattttttctcatcagctcttcaagacctggttcaaatatgggggaaatgccctttctcatttcatcaatcttgtgagcgtcaatatcaatgcaggttacatgatgtccaatctcagaaagagaaacacctgtcacaagaccgacatagcctgttccgatgactgttatattcattgtttccctccaacagttaaattgctgctttgcagcttccgtaatatcgtatgagaacatcctatcatgaatgcgaatgatctcccgcatagcctgtcgggtacagcctgtacagatttctgaaatgtgattcaatcatacaatacactattatatcgctctcaaaaagaaagtggtgaaatgagaatcggctgttaaaaaagaccaaacaattttcttcttttgaccggttgcggaggctgtctgaagatggtctgattccgcaggagaagctctgcattttccgtcagcatataaggaagttccgagccgaattctttctctagaacataaagggcctcttgagtgtgaaaatttctcgttttcacattatgggcatctgaggctacgaaatggatcaaattggcttcaaccagccggagagaaaatgctttcagctgcttgccgaaggtccccgcaagacttcctgaagtaatctgagatgctgctcctttttccacaagatgatacagcaaggacgggttttcgcgaatttccctgttgcgttcaggatgggcgataaccggaatatatcctttcagctgcaaatcataaaaaagctgctccgcatatcggggaacgtgatcaaacggaaactcaatcaagatgtgttttgtatcattcagcgaaagcagctgctgtttggcaaggtcttgttccacctcgccgtagattctgatttcctgtcccggaagcacatgtaaaggaatgtcttctttgattaaacgtttgtttaactgatctgctgcttctctgactgcagctggctcgtttttatacacaccgttgttatgatgaggtgtcgcaatgatcgtccggattccctgacgaacagcggctcttgccatttctatgctgtcggccgaatcacctgccccgtcatccattgcgggaagaatgtgacagtgaatatcgatcatgtcctagcccccttttttcgcaaaaataaataacgggcacgatgcacgttatttattttgcatgaaattgtccttgtttccgtaatatccgtattcagagtgcttcgaaagctttttgccgttcataatcgccccaagaagcttgcttttgcacgtttcaagcgcctctttcgcttttgcggcttgttctttttctgttttcccgcttgaaataaccagaacagaaccgtctgccacgttgcctaaaatctgtgcatctgctacggcaagaataggcggcgtatcaaaaatgaccatatcatatgccgcacacgcttcgtatgcaagctccttcatccacttcgaggagagaagctcggccgggtttggcgggatcgggccgctcgtcagcacgtcaagatgtttttcattcgatgcctgtacagcctgctccatagagcttttctttaataaaacagatgttaagccaaccgtattttcaagaaaaaaggccgtatgtactgttggttttcgcaaatcagcatcaatcaggagcactttttttccctgctgggcgaatacgacagccaggttggcggccgttgttgattttccttctccgggacaagccgatgtgatcatcactgatttcatctggcggtccactgaagcaaattctatattcgtgcgaatcgtccgatattgttcagagttcaaggatttcggctctgtcattgcaatgacatttctccgcatccgcgagtctctgctttttctaagcgccaaaatgtccactccccgttttttcagattggaaaccctgtaaggtctttgctgttttctgctcattcgcaatggtggaaactgtccctaaaacaggtatgtccagcaaggattcgagctgctcttccgatttgatcgtattatccaaatgctcgagcaggaaggccagtccgatgcttcccgccaatccggctgcaaacgcgatggcaatgtttagtagcggctttggcgatacaggggacggatgttctgaaacctcggcttttgacagaatgctgacattgtcaacattcataatggatgtgattttgtcttgaaaaacagatgctatagtattggcaatatgagccgctgtttccgcgttttcatccctgactgatatgttgaccacttgggagtcctgttcgctggatacggtaattttgtcattcagttcttgggatgtcatcgacaggcccatttctttaatgacttcatctaagatggcaggacttttaatgatgacattgtacgtattgattaactgaagattggtttggacatcgttaaattgaacttcttttcgttcatttttcgattggttgaccagaatctgagttgaattttcatagatgggtgtaagtgcgaagaaactaatgagtccgccggcagcagtggcagctgcggttacaatcataatcaaaagtatgcgttttgttaacgttgataatatctcttttaagcttgtagattctcccatgatacctccaaatctcttataacatccttttccatctacgattatacaacgttgaaaccgcatttctccagcttttcacgtgacataattcgacatttttttacaaaacgaaatgttactcttttttatgtaagcgctatatttactgtgttgacagcgctgtctcattttctcttattcgtgcagtcacgtaacctcgcataaaaaaatcccgcaaaaggcgtgcgggatttttatgttgcatatccatttttaatatgagaaatcaaattttcaagcatttccttcgtcgtcatctcagatgactgctcaccaatttcatgtgcatgcatcaaaattttcagaaattcttcttgattcaatttcttttcactcatcttttttttcctttcagcttccattaagttgaaaacacgattattatatgatgctggttatcaatttgcaatctctaatacatcattcgacacatcccattttttatgtccttttttaggaaaaactttttaaggccgatgtgttgcgatataatagagaaattggatctttttattacgtgactcggttaggagcgataatcatgcttcagaatatgatttccaaagacgatgtgctggcatctgctgaacagttaaaagaacttcttccttacaatgaggaaaatgttcagctgatcaaaaaagcccttattttatatcggcaggattcagtctatcgtttacaagcagtgagtccgacggaagttacggcttacgtgcaggatgttgtgcctgtgcgggtcacattgaacttgtttgtcatagtcaaaagcggctgttcatgtccgtccggaagaatctgccgccatatgctggctgtgtttttatatgtatatgcaatgttcgagcgagtgggtacttttacagagcattggctggagagggaaaagcttgaggaaagcaaagagctcgtccgccgccagtttcaggaaaaggtgctgcctaatgaagaatcgctttcaagctggcttgctttttttgattcagagttttctctctggcaggcacgtacgccagaaggcagccaaaacatgcagggcctctattacggctacctgtccgcattaaaaaaacatgcgccgaacaagccggagctgaaaagcctgtatcagattcattccgcgattgcggtttggcttcgcatgttcacattgattgaagcgggcaagctgaaccccgaacaagatttttattccctcaatccgtacgttgaacagctgatggatacaatctacagctctattgacaaattaaaaacgtacgcgctgtcttttgcgcttgatccgtttttggataaaacaccggatgttatccgacctttgctgttgaaagaagaaattttccaatatgaacgcatccgcgtcttcggtgaaatttggagtgcgctgttgtcgcggccaaaatgggtggcacgcgaacaggagatattgaaaaaagaagctggacggcgtttttctcccgaattgcaattcgggcgcctgcatttggaattcctgcaaaagaatgatgacgttatttttgcggaagcggatcaattcccgccggaagcgctcccttatacgttccaatggctgagtgaaatgactgccaagaaggactggaaacggcttaaaacatggtaccagcaaattgagccaattgcgatgggttatacgaagctggataagccgtttaaagagattcgcgatgtgatcggcgagctgttccttctgttgaatgcctatgtgcagcaaaccaatgatcaagcgctgtttgagcgctttgccgcgggctgtctgccgtatacgttcacagaatacagccatcatttatatgaaaaaaaacgctatgccgagtggattgaaattcatagccttgtcggcttttccatcaatgaaatggataaaatgatgctcaaggaaattgcagcgagcgaccctgaggcgcttataccggcttaccatagagaagtggcttttttcattgatcagaagaaccgcagctcgtacaaggaagccgcccggtatttgaaaaaattgcgcaccctgtacaaaaaagcgaaaaagcagaaggtgtgggagcggtatattcagctgctgagctcgcattacaagcgcctgcgtgcgcttcaagaagaactgcagaaaggaaagttgattgatggcgagtcttaaagaaattctcatccacgtcgaacaaatggaagatgggtcatttacgctctcagcctttgatgaaaatgagcagcctcttccctacagccatatgaaaaagcatttgttccaatggcatgaatcctcattttacggaacctttctagaggatgtcagcttcatcgggacgactgctgtcctgctatcgccatggatgactgtagagcttctcggcaaaaactcgttcaactcattcagctccgtgcagcttacagaagaaacggagccgctgatcgaggcggcatcgaccatctatgaatttatcgcggacggcgattttctgcctgactatgacgcatggacaaacggtgtttttcgctggaaagaccgcgataatatactggaaggctttactgcggaatggttttccgctgccgtacaggattacatccagtacgacgatgacctgcgggagaaatgggaacatatcaaggaaaaatcgcctgcggttacgacattccgcggccattttcttgatgaagaggattttctggaaggcattggctggattgacgatcaatctccatttactgtcggcttgcgcttaaatgaaccggactttgacggagacgaatggaagatcgagatgtttttacgcgataaaaagagcggcgctgtagaattctttgacggactgaagagcctcaaaaaatcgtggcaggcgtacagcgataaaatcgcgcgtgagcaggaccgctttcacagaacggttccgtggctgtcgtttgattccgggacaacgctgatctcggaggaagaagcctggatcttcctgtcagaagcaagtgagacgcttgtcgatatgggggtagaaatcctcctgccgtcctggtggcagattgtcagagacagcaacatgatgctgaaagcaaaggtgtcgtcctccccgcgcggcgagtcatttgtcggcatgaatgcactgcttgatttcaactggcggttcgcgacaaatggaattgaactgactgaggctgaatttaatgagcttgtcgccagcaacaggcgccttgttaatatccgcgggcaatgggttaaaatcgatccgcagtttatcaaacagatgaaacgcctgatggaaaaagcagaatcagagggactccacatgtctgatattctggcgcgcgagctaatggatcagcaggatggcggacttgaggattcggacctgattgatacatctgcttttgccggcattcagtttgatctgtctaaacagctcaggtcactgattcgaaagctcactgccgcggaaaacctgccggagcacgaagtcagtccttctttcaaaggaacgctccgcccttatcagaaatacggcatgaactggctgctgtttctgcgggaaagcggttttggcgcctgtctagctgacgatatggggcttgggaaaacgattcaaatgatcgcctatttccttcacgtgaaggaaagcggccggcaaaaaacgcctcatttgattattgcgccgacatccgtacttggcaactggcagcgggagcttcaaacctttgcccctgatctgtctgtcgcgctccattatgggccgcgccggccaaagggtgatgatttcgccgcgcattatgaaaacgcagacgtggtgctcacttcatacggtctgtcacatgccgatactgaagagctttcttctgtgacatggaacacgatctgccttgatgaagcgcaaaatattaaaaacgcgcatacgaagcaatcacgcgcaatcaggaagctgaagggtcttcatcatatcgcgctgagcggcacgccgatggaaaaccgcctgactgagctgtggtccatttttgacttcatgaataaaggctacctcggcagtttgaccggcttccataaacgctatgtgctgccgatcgaaaaagaccgggacgaaaagagaatcggacagcttcagcaattaatccggccattccttctccgccggacgaaacgggatgaagaggtcgcgcttaatcttcctgagaagctggaagaaaaagaatttatcccgctgtcagccgagcaggcatccctttatgagcagctcgtcaaagacacttttgaccatatgacgtccctgaccggcatgcagcgaaaagcgctgatcctcagcatgcttggacggctcaagcaaatatgcgatcatcccgcgctttacttaaaggaagagcaaaccgagctgctggccggcagatcagtcaagctcgaaaaattgctggaactgatgacagcgatccgcgcccaaaacgaaagctgcctgattttcacgcaatacattcagatggggaacatgatgaagcggctgcttgaaaaaacgttcggggaacctgtgcaatttttaaatgggagtctctccaagcaagagcgggatacactcgttgagaaatttcaaaggaaagaatatccgacactgattctctcactcaaagctggaggcaccggacttaatttgaccgccgccaatcacgtcatccattatgacagatggtggaacccggcggttgaaaatcaagcgactgaccgtgcataccgcataggccaggagcgctttgtccacgttcataaaatgattacgacgggaacaatcgaagaaaaaattgatgtcatgcttgaatccaagcaaaccctgaacgatcaaattatccaaagtgaaaactggattaccgagctttccacacaggagcttgaagaactgtttacattaagcgctacagcgcaatgatcatgactaaaaaagctggctctgatagagccagcttttttccgttcatagccgtcacgccgaatctccaaaaaatccgttacgccggttatatcaacaggatgcgcttttggagcagcacatatacctacagcaaatgtttcatcatatgtgcgacaccatgttcgtcattggttaaggtgacagcatcggctatcgatttgatgtcttcccgggcattgcccatcgctacaccttttcccgcagcctccagcatcgatttgtcatttaaactgtcacctacagcagcggtttcctcgagcggaatattcagctgttttgcaagcctcttcagcgcctgccccttggaagctttgcgggaagaaagctcaaagttgtgctcagccgaactgacaagcgtcaaatcttcggcatgctcatatcttttccagcctgcctcaagcttttctttgaagaaagaaaagccgagaatattgtaaaaatcgattggctgatcggcttcaaacagctcttgaaaagagttaatgtaagcaaagcccgattggctgtattgcacctcggccgcctgcttaaggacagaaagatccgcttccgggtttgcgcttctgaatctgtccagctcaacatcaagaagttctctgccgttttgcggtgtataaatcgctgaacctgtgaatacctcataataatagttttccgactcaagccatgagagaatatcatacgcccgtttcttatcaatcgtttcgtgatgataaagcctgccgtcgggatcgtgaatgacggcgccgtttgcactgatgacccatgttttgatccccagcggttcaaagattgacatgacgtcaaaatgagcgcgcccagttgacaccaccacttcaatgccatcccgctgcgcctgccgcagtgcgttttcattttccaagcttacctgatgcttgctgttgagtaaggttccatctaaatcaatcgcaattaatttcacgtttgtcagtcctttccttcatcctgctctgtcacgagaagctcaacgccgtttcggtcaagcaagtcacaaaatgcctgattcggcagcctgtctgtaatcaaaaggtcgatttcattcagctccgcatactgataaaaactggtgctgcccagcttcgaatgatctgcaagcgcgatgacctgctttgcctgctgtatcattttccgcttcaccatgccatcctcttcatgcgcaattgtaatgccatgttcggaaataccgaccacaccaatcagcgctttatcaacatggtagcttgagagcttttcaatcacagaggacccgtacagaaagcggtgctccttttccagcttgcctcccagcagataaatttcaattccctctttatcggacagcacatccgcaagattaatcgaattggtgattaccgtacaatcaaccgcattcaaatgctttgcacatgcttgaacagttgtagaggcgtctaaaatcacccggtcaccatcatgaataagcgatgctgcaagcctgccgatcttatttttttcctcagacactgttttcaggcggccggaatagctttgaattttctgatgcacagtcggcaaaatggcgccgcctcttgtgcggatgatggcattctgttcctcaagtttcacaagatctcgtcgcgctgtatcccttgacacttgcaggagcgtacagatctgttccgttgtaattcggttatgctgttttaaaaaatccaaaatcgctactaatctttcttcttggtacacgccctcattccttttctcagcaatcatttataagtaattataagtttttatttaattctattcaacattaataagtgattttaagtaaaaatacgtcgagagaaccaatttttcctaagtggacaaaaagaaagaaccagtctggtcgactggtcaattttgaggggatgatgcgaagattcggataatggtgaatggatagataacgggaggagcaaggggtgtcaatcagcagctttttcccggggtttagggtccataaaacgaacagtgtcagccaacacttctgttacatacacgttaacgccttccgcgttttcatagcttcttgtctgaatccgtccgcttactccgacgagagaacctttttggcaatacaacgccgtgttttcagctgtttttctccaaagtgtgcaattgacgtaatcagcttcgatttcacctgaagcattcttgaaactgcggttcaccgcgagcgtaacatgtgcaactgccgcaccggcggaagtgtagcgaagatcaggatcttttgtaagacgtccgacaagcatgacctgattgaacatgcgattcctcctctccttgcggttgtatgtattgtaaatgatgcaacaagaaaagaaaaacgcttaaaaatggctttcagcctctgtttttatctttcgttttcatttttccttcagctaaaaacatcttttgctttttccctttgaagaaatatgtactttttaaaaaacggaaaaagatttgctttgtcagccagttttgcgtattcatgcgcacataggaagagccatcccacgcaaaccactgaaagctcaattttttttccggcattgacagcttgattttatactgctccatgccatcttgtgtttcgtataaaaaacttattcttccttttttgttcagatgaacctcaaacacttctttacggcttaacatatatgttacttccttttgaatcaaatggctttcagaaggagcgccgtcaatataaatttcttttaaacgaaattgattcataccacatctctccgtaatccatagtcagttacagtataatgaaaaaatagaaattattaaatgtttcgctcatacaaaattctttagccccagcattgcaggattttttcctcgaaaacgtttatgttataatggaaggcaagaaaactttggaagtaatcggggtgagaagaaatgaaaacctttaaactggttgacctgaatgtggaacgagtggacaaggaagaacaatcaatcgaacagtttccccttattgacggactgattataaataaagaagacggtgaaaatcactggctgattgaggcgcttgtacagaaagaacatctgtctttttttgaacagcttcaaaacagccaatctgaagccaaagtatttgtaacgatcacgaaaaaaagcaatcgccccgcccagctgacagcagcagtgaaaaatatcgtcaagctggaagaaagcatccaggttttactctatggacaaatggtaacaagaaaacagcagggcactgaaaccattctcgagtcccttgtaaaagagggctatacaggaacaaaactcattgaggcatttaaacaaaagttataaatatgagggggcatgttccccaaaacagacacagaaccgaagagcatcacaatagacatttagaatagatatgttctgcatgaaaaaagctgccgttttgaacggcagcttttctcttcgtgctttcactcttgcatatttaatttgtatggccaaaagaatcaaccaattcccctttcacaacaaggcgcccttcagttttgacagccttgtcacatgtgattagcgtaatctcttttttgtttgtctcctcaactacatctgcatccgtttccgatatgatgtctttagatgttacagaatagatataatcctttttaaaatccgtgatgacaatttgggcacctgtttttatattctccagaggtccgaacagaagattcttttgcttcaaatgatggcccgccaacggataatttccctcacccattttttgatccgggcgcattgttgccgcccctatcaaaagattttcattggttgtgccttttacgatcggaagctccagatcgacacttttaattgttatctgccgccttgattgtgaagtaaaaataagtatatttcacgtgctttcgacgttctccacttgactggaatgctttaatggcgatcccggcatctgtagcttcaggctttccttcagaggaatcagaaatctcaaactctattttctcagtgttcagcacataaccggctggcgctttcgtttcaacaaaagcgtattgtcccggtgcaaggcctgaagctgtgactttatgatgccggatatgactggtttcgaagtctgtatgaaaattcgcgaacgattcagcatggtggatcttccggttctgatcattacagctgccattatcggccatgacaaatacaaggcttttcatgccggagcgaatgacattttgcaaaaaccttatcattactctgaatttatggcgcgtattcaaaacctgatcatgatgaaacatacagcaaatcaagccacaagaatggaaatggcgtttctccagtcgcaaatcaagcctcattttctttataatgtattaaacacgattatttctctcactcatttggatattgaaaaggcccgggaggtaacagaggaatttaccaactatttaagaatgagttttgactttcaaaatacatcagccatcagttccttcagacatgagctttcgattatcaattcctatctttctatagaaaagacgcgattcggtaatcggcttgaggttcttttcgatatagatgaagacattgactttatccttccgcctttaatgattcagcccttggtggaaaatgccgttcttcacggtgtcagcaagaaaagaggcggaggatggatcaaactgacagctaaaaaacaaagcaaaaatgagtatcacatcaaagtagaggataacggtgcggggatgcctccggaaaaacaaaaagatctcttatctgcggatttcgatcgcagcgtcgggttgaaaaatatcaatcagcggctgaaacatttttgcggaagcgagttgatgatcatcagcactccggatgcaggcacctctgtctcaatgctcattcatctcgctgaaacaacagaaagccccgcgggactgaaggacatagaacgaacctaaacgaaaattgagataaaaaaaagacgccgtttataacggcatcttttttattccggcgactttgcttgctgcttcagcaggtctctgatttctttcagcagctcctcctgcgcatccaccgcttcctccgcagcctcttcttctgctgcttcttttttgcgccttaacccattcaaagtccgaatgacgataaaaatggagaacgatataattaagaagttcacaatcgtctgtataaagctgccatacttcactacagcatcgccaaacgtaaacgacaggcctgaaaagtcaagccctcccagcagcaaaccgaccaaaggcataatgatatcatttactagagatgtgacgatctttccgaaagcgccgcctatcacaacaccaatcgcaaggtctacgatattcccccgcatggcaaaggctttaaattcattccacatacaatcacctgcttttctatatttgtaaagaaaaaaagacaaatgtgccgctggccatctgccttttttcaattattctccgagggcaaaagtcagttctacttcgcaaacgacttcgccatcaactgtggcaacgccttttccgcgcccgattgtgccgcgggcacgaatgatttcaacctcaaggtgaagctggtcaccaggcttgacttgttttttaaagcggcagttatcaatgcctgcaaaaaaagccagtctgccgcggttttcttctttaatcaacatcgcaacagctccgacttgagcgagtgcttctacgattaatacgccgggcataaccgggtactgaggaaaatgtccgttaaagaactcttcattagcggttacatttttatagccttttgcccgtttgccctcttcaacttccgtaatccgatccacaagcaaaaacggataacggtgaggaataatttctttaatttgctgagtatcaagcattgtcttgacatctccttcatctgcattagtatgtatagcaatcatcaaagatccaatctgtacatttgaaaagtatattatgaattaatctctttttcaaccgcgctaaaatgtaaccaactgtcaatgagagccgtcaaaagttatgatatgataattatagattttaccaatagcaaagaggtaggaaaatgatttcgaagtttattgaaaaaagaatgctaaacatgttagacgagtggtattccgcaatgagcaaacgcaaaatgaatcacgtttgcacactgaaagagaaaattgaccagcaccttccaaagatcaaaaagaacacaaaactttggatgcgttatcaattgtttcaggcccgccatcagctgctttttgaaaaccagaacggactcgattcattgttcgatgacctatatggcctggaagacaaaatggatgatgaattgaaatattatctgtattttttctctgggttatatgagatggtaaaaacagctccgaaacatgcagtacatcattttaaaaaagctgaacagtacctggccgccattcaaaatacgtttgaagccgctgatttatattatcaaaccgccggcgcctattacttgatgaaatcaccgccgctttccatccaatacgtcaaaaaagcattacacatctatttgcaccaattcggctatatcaaaaaggtaatcacctgtaaacttttgctcgccgtgaattatattgatcaagaacgctatgaaaaagctgaacagcttttcaaagaaatcattaagaaaacccagcaactacatgacgaaaacctgctatgccacgcttattataaccttggctttttaaaagcgaccgagaaaaaagaccaggaagcgcttctttactttagaaaagtattaaagaatcaagaatttgaaatgaattcaccagtctcatatcttcattgtgtgtacgagtctgtcagagcgctttttaaaacaggaaacatcacagaagctaaagccgtccttcaaaaaggaaaagaattatctgaaaaggtagacattcaaaccatttatttaaaattaaaaacgcttgaagccctctacacctcagtggaagatccctatgagcagctgctcgaatatgtgcttgaattagaaaaaatcgaggcgtgggtggatttagaagtgctgttagaagatattacggaatactacaaaaaaaaggacgatttcgaaaaagccgctttttttatcatgcgcggctgattgaaaaacgcccattttcttattatctgactgaattgattaaaccgagcatttgatctcccattgtgatcgttctgctgttcagctgatatgaacgctgggacgtgatcaaatctgtcatttgttctgaaatatcgacattggacatctcaagtgagccctgctgcatgccgatgttttgtctattagcgccgtttagctcttcaaaagctgccgcattatcaatagagaaaaggttattcccttcggatttcagctcttgagggttattcacttggacaacgccaagattaaaccgctgaaccgcgtttccgtcagatgcggttaaggtgccgttcttattgatggtgatattcttcattgagctgtcgatgttcactgtattgccgttctcatcaagtacgggatacccatttccagtgacgagctgcagctggttggcattcgcagcggacggcgttacatacagcgccccgtccctcgtatactggcggtttccatttacatttacctgaagatactggtatggagacgtaaatgcgatatccagatcgcgatcggtcttctgaatgcttccttgatcagagaccaggcgtgaattcatcatcgctccgacgccaaggcgtaagccgggcggcgttttgcgggcttttgccacttcctcgtttttttcatcaacctgatcgaattgctgtctgacaagctcagaaaaattcgtatcttttgccttatagccggttgtgttgctgtttgaaaggttgctgctgattgtgtcaatctgctgctgcagctggtttaaggttgttgatgccgttagcattgacctgagcatagttgatgtcccccgttttttcttccgttatcttaaatttttccaatttcatttgctgctttatccatacttttatcgtaagcctgaataaccttctgattcgcctcaaacgatctgtacgcttcagtcatttctgtataggcgcttgtcacatccacgtttgaaagctctgagacgccttgttttaatgaataggatacctgattgtttccggctgcgcttggcagatcattaccgtccgccgtgctgtacaaatcatttccgtcccgtttgagagtgcggacatcttccgccattctgacatcaatctggccggctgtgcgtccgttcgttgtcacagtaccgttttcagacacagtaaaattctcattatcaacagtgattggctggcgatccgtcgataaaatagggcgtccgttgatcgtcagctggttgttctcatttagtgaaaatgtgctgctttttgaataacggattccatccgctgtttgaaccggataaaaaagagcagctttttcattggtttccgcattcatcggaacttgattttcgatcaatgcaatgtctgtaggctgatctgtggacttcaggcttccctgtgtgaagagaggcttgagctcctgcatatacactccggtattcacggaaccgatttccgtcctcgatgtcccggccggagattttgattctattctgctgagcagcatttcagggaacgcgcgcatcgagccttgatcagctttatatcctgatgtatttgcgttagcaatattatttgaaagcatttccgttcttcgctgctgggcaatcattgcggatgttgctgtatataatccttttaacaaatttcccacctctaaaaatggcattttttccagttgtcatataggaacgttcgttctataataaaaactcagtattttatcctattatcgtcatttaacatcttttcgtgaaggctttttcataaaaaaacctcattctttttcagaatgaggtttgtgaaatcagcttagtttgcgtttaggaagcttgtccatattatcaagcatgacacctgtgccgatggctacgcaatccataggattttcagcaacgaggaccggtaccttcagctcttcagcaagcagctggtcaaggccgtttaagagcgcgcctccgccggtaataataacgccgcggtcaataatatcagcagaaagttcaggcggtgttctttcgagcacttgttttgcagcctgaacaataacagcgacagattcacgaagggcttcttcaacttctttactgtttactgtaattgttcttggaagaccggaaaccatgtcccgtccgcgaatggaaatttcctcgtgacgtgcgtctgggaaaacagttgcgactttaatcttaatatcctccgcagtacgttcgccgatcagcagcttgtactcgcgtttgatataatttaagatttccatgtcaaacttgtccccagccattttaatagaagaggaggtgacaatatcgcccattgaaataaccgcgatatccgtcgtcccgcctccgatgtctacaaccatgttaccgcttggctggaatatttccatacccgcgccgatagcggcaactttaggttcttcttcaaggtacacatgtttcccgccgcttttttctgcagcttctttaattgctttttgctcaacggatgtaatattcgtcgggcagcaaatgagcatgcgcggctttgagaacaggccttttacattcagcttgttaataaaatgtttcagcattgcttctgttacttcaaagtcagcaataactccgtctttcagcgggcgaatcgcaacaatattcccaggtgtacgtccaaccattcgtcttgcctcttcgccaaccgccagcactttgccgctgtttttatcaagtgcaacaacggaaggttcattcagaacaattcctttacctttaacatggatcagtacatttgcagtaccgaggtcaataccaatatcccttgcaaacatctatttatatcctccttgaaaatctgtttcacagtaaatatccacattgtgccctaattatatatattatcataaaatatagaaaaaaagttggaagcacaataagttctttacaaatttttgcggatgttttatgaacgatttcaagaaggcaatgccaggtgattacgattgctgaacaggctctccttcgagaatttcatcttttttatatttgagctttgtcgcttctcctcctcttaaatgcctgatggatttatgataatcgagtatttctttcacttcgtttgccaagtcggggttaatttcaggcagacgctctgttaaatccttgtgtactgtacttttggaaacaccaaattccttcgcaatgacacgaacggttttctttgtctccacgatgtacttccctatcttgattgttcgctctttgatgtaatcgtgcacaccactcgacctccctaaaatggatgtgagaagtgtgaaatgagatccgtattctgtaaagagtcgttcattatgccgcttcttcgttgtatggttttaaaagtaagtttgtgaaatatgcccacgatccctcacctcaaacactctctttgttaggtttgtaacagtgtattagcattcttttgggaatatgctaaaaactcaataaggacaaggggtgaaacgaactttttcagattcagcaaactatttcgcgtcactaaattttcatctttacaactattgatcgctcctgtaaaatgaaataagcaattagttacttaggtaagttttttagaaggagaccgacatgtcctacgtcaacagacacctcattcatcaaatcaaccaaagcgcccgcctgattgccaagaaagccaatgaacagctagagccattcggcctttattcatctcaatggtcagttttatattgtttgcgtacgatcggaccaatgactcaaaaagagatttggtcctatttaaatgtggaagcgccgactgtgactcggacgatcaaacgcctggaggagaacggctgggttcagagacggcaaggtgaagacaaacgggaaaaacttgttgtcctcacaaaagaagccgagaaaaaatacgaagaaatcaatgtgaaaatgttgaaattcgaggaagagctgcttgcagatttccgggatgaagataaagaagctttttctcatttattccgcatgtttttacaacaatgaaaataaggaagtgacatacacttgaaaaaagcggatgcgatatggaccaaggattttattatggtcctgcttgtcaatttatttgtgtttgtgttcttttatacatttttaactgtattgccgatctatacactgcaagagcttggcggcacagaatcacaaggcgggcttttaatcagcctgttccttctgtctgcgatcattacacggcctttctccggagccatcgttgagcgtttcgggaagaaaagaatggcgattgtatcaatggcgctcttcgccctatcatcttttctgtatatgccgattcataacttttccctgctgctcggattgcggttcttccaaggaatttggttcagcattttaacgactgttacaggtgcaattgccgctgatattattccagccaaacggcgcggtgaagggcttggatactttgccatgtctatgaacctcgcaatggcgatcggacctttccttggtctgaatttgatgagagtggtaagctttcctgtattctttacagcctttgcgctgtttatggttgcgggcttacttgtttcgttcttgataaaagtgccgcaaagtaaggacagcggtacgactgtattccgttttgcgttctcggatatgtttgaaaagggcgcactcaaaattgcgacggtcggtttgtttatttctttctgttattcaacagtcacatcatatctgtctgtattcgccaaatcagttgacctttcggatatcagcggatatttctttgtttgttttgcggtgacaatgatgattgcacgcccgttcacagggaaattgttcgacaaagtcggaccgggcattgtcatttatccatcaatcctgtttttctctgtcggactctgcatgctgtccttcacacatagcggcttaatgcttctgctttcaggggcggttatcggtcttggctacggatcaatcgttccttgcatgcaaacattggcgattcagaaatctccggctcaccgctccggttttgcgacggcaacgttctttaccttctttgacagcggaattgctgtaggatcgtatgtattcggattgtttgtagcatctgccggcttctctgccatttatttaacagcggggctgttcgttttaattgctctgcttctctacacgtggagccagaaaaaacctgcagaggctgaaggaaaagtgtctattgcagaataacttgtcagactgccgggaaatcccggcagtcttttttccattaaaacacggcgccctctcggttgaacgagagaacgccgcttatagcaattattcaatgacaggccgcgcaggtgaatcaggatctaacgaaaaatcataggacgcttcatcacgaaacatcggatcggcatatatggattgttgatcgttttttgttgcttttcgatacgaagaaaatgaatcatattctttctttttccacatccatatgccgtcttgatccgcttccttgtggtacacgttatgattgaccgtattaccttcgttttctgtaaagtcgtttccgataaataatctggaatcaccggccgtcaatatattcttttcaattgtgttgtttttcgtatcgtactgcagcagcagctgtccgccgtacagtccctttgtgtcattccggtacataatattgcgggcaatcagagaattgctggtgccgccccgctttttgtcatatcctccgattgaaataccggtgtacgcattgttgtacactttgttgtctgtgatctgaatggcatttgcatactttcctttgtgttcagacgttgcttcaatcccaatatcgttatcgtaaactgtgttgttcttaatttcgatatcgtgtcctccatcgacataaatcccgcccgctgagtattcatctccataagcaggattgccgtaagtcgagttttgataaactgtattgttttctacgactccgtttcgcacgtaatcgtttttatccgcggttccctcataaccaattagatcaatcccgatgttattattgttgcggaccacattgcctgcaactgtgaagccgtcgatattaccgttcagcacaactgcttcactcgctccaagcgtcagtttctcaactgtattgtcctcgattcggatgtctttcatgctgccagtcccataaactgcgattccgtgagcatttccttcatccgctgttgtcttaatcccccggatgtgattatccttaatggcgatatgactgctggaccctgatacataaatccctatagcagttgcttcctcagatgaaacagaaagatcttgaattgttaaaccgctgatggcaatgtcatgtttatcgtgaatacgaataagcggtgtttcatattcagcgttcgcaacggattcaccgctaatcacgacgttttcattttcatagtttcggaatgtgataggctttccgtccgtaccgctgtgctttacatcaagggtctcatgatacgtgccctcccgaatcatgacagttgtgccggcagcagccttctcagatgcgtgtgccaatgtacgaaacggcttttcttttgttccttcattttgatcactgccatttggcgaaacatacagataatccccagatccttcctcattcgcttttgtcttatcataaacgaaagcgaggatgacagacgttaaaacacccgccaaaagaataaaataccattttctcattttcgattcccatttcgttttagaatagatttctaaaaccattataaatgttctatttatggaaaaccatttcaaaaatatgaaaatataccgtctaaatagatcttattcagcctggcggacctgcgcatgttcaactgtttcaattgccaatgatgcaggcgggtgaacacgcatcagaacaatgtagaaaagaaaggaaatcagcacacctacaaaccaagaaatatcgtataagctcttcaatacaggaacatacatgccaatcagcgaaatcagcgctcctaacattgtggctgcaaacgcacggtaattgtagcccttccaatacacataccgtcctgtttcggaatacaggtcatctaccgagagctcacgtttgcgaatgataaaatagtcggccatcatcacgcctgccaccggtccaagcatgccgcctattaagccaagaaacgcatacacgcttgtcgcgctctccatcagcttccacggaaccgtaaataaagcgagcaacgctgtgataaagctgccacgtttgaaattgatatatttcggcagggcattcgctatatcataagcgggtgatacgatattcgccgcgacatttacagagatcgtggcgatgcagagtgtgatcacggacaagacgatgacataagggttatcaaaccgcgccaaaatatcgacaacatcccaaatcggctctccgaacgcgacctgcgagccggaggtcaccgtaatacttgcgaatgcgaacagcgcaaacgttcccggcaaaccgtaaaattgtcctttgatttgctctttttgtgtttcagcaaaccgtgtaaaatcaggtatatttaagatcaatgtcgcccagatgccgatgatgccagtaactccggcagcaaacggccagaatgtttctgaaaacgtatgaaactttcctggttgagagtatatcgggcccaatcctccagcaatatcaacggcccaccataccatgccgccaaataccagatacactaaaggccctgcccacacctcaaaacgtttaatcgactccatgccgtgatgcaatacgagtaaatgaatggcccaaaagaatacaaaggaaagcaaaccggacaagtgaatgccgagaatgttccactcgccgccaatttctccccaacctggccacatattcaaaagcaaaatgttcagtgccgtgctacccgcaaaggtctggatgccaagccacatgatagctgtaaacgcccttagaagcgcggggatattcgcgccgtatatcccgtaagaagcccgaatgatcactggaaacggcagcccgtattttgtccccgcatggccgtttaaggcaagagcgccaaataggataagtgatgccgtaataatgatcgccagcacctgccaaggcgaaaggccgatcgcaattaatcctcccacggtcgcgtaggtcggtatgttatgtatacatcccatccaaatggaggcaaagttcattgctttccacgtccgtttttcctgtcccaaaggcaccagatcttcattgctcagcctgttggattgctgctgactctcttttaatttcatagccggctcccctttccatattgtctatatgtcgtcacacgttatgttttttgacattagatgtcacttaatataactgaagagtcagacaataacactggctatgatatacaattttcccgtttgtatttgaacaacttaaacaagaaaaagagacagacctcagagcccgtctctttcttaagatgcagttttcattaatgcagcaaatctcacagccattaacaggcttgctccgcccgctataatcataatgattcccatcatatcaaaatgggctgccgtgatttctttaccaaaaagaatgccaaggatcaccgaagacaaaatcgatcctaggtaacggcaggtttgaaacaggcctgaagtcgttcctaccatgttggaaggactcgtttccagcatcgctgcctgaagcgcgacattgcccagtccgtagcctatacccaagagcgacagaatgaggcctttaccgatggtctggacattgataaaaaagatggttaagagcacggctccagccgtcatcaaaagcgctcccgcaaagatcggcttgacgacaccagatcggtcgatccatttgccggttagaggtgacacaacgatgctcattccagacataaacagcataaacaggccgctcgtttgaacagaaagatgcatttcatcctgaaagtaacttggcaaaccaaaaaataaacaatagaagaaaacattcaataaaataaactgaacatacacggctgacaggtttcgctgtgttttaaacagacggacatcaataaacggcttatccgttttcagctcgcgccagacaaacgcacagagcagaagcaagccaagcacaccttcaaccgcatgcggcgacgtgctgaacgacagcaaaaaggatagaaggaaaatgattcccccggcaaataaaacaattccaagaatatcgagctgccgaataatggttttgattcctgccccttttttctgatctttcgggaacatatacaggcccaataagaagctgaggataataaacggcaaattaacgataaagatcgccggccagcctccccatacaatcaaaaacccgccgactgtcggccccagcgccgtcatggcggacgcaaaaatagagagtacagccaaggctgaagcttggcgctcatgaatatgattccgaatcaagccgacacctgacggataaatcgcactgctccccaccgattgaaacagccgcatgaccaataatgtcataaacgtcggcgcaaacggcgccccgatggcagaaaccgcaacaagaataagcccgaataaaaacaagcgtttccgcccaatcaaatcaccgagctttcccgttacgggctgcgctacggcactcgccaagtaaaacgaggaaatcagccaggaaaccgttgtaaacgagaggtgaaactcatgctggatgctatggagcgcaagagagatcatagacgagttcagcggattcagcattgttcccgaagccacagctgttaaaaaaacagctcggctttttttcgataacatcatttcacttgttccagaaactcttccgttgtccgcgatttaccgattctcgggaaaataaagcgcagtgtggcttcatgctcttcatcgctaaatgtggacatggcatctgtaataaaaatctgctgatagccaagctgaaatgcctcccgtgctgtgctttccaccccgatattcgttgcgatgccgcacaatacaatcgtatcaatgccgcgacgtctcagctgcaagtctaaatctgtgccaaaaaaagcaccccattgccgttttgtcacagtataatcgccatcctgcacaccgatttccggaacaaattcggcccagtccgccggcatttcccctgaacctccctgcgcaggctcatccgtttgcggcttcagggcgtccgctccatcatgaaaggctacatttacaaagctgatgaacccgttatgtttccgaaattcatctacgagctttttcacgttcgggacaacctggccgctttgatcaatcggcacaatccccttttgtaaatcaatgataaccaatgctgttttttgaaaatcaatgttgagtgtattcatcatacgtctcctcctgatactgttagtgtttctcacattgcatattttactcttcacactgcctaagttcttttatgatgcttgtgaaattctcagaaggagcgttttctcatgatttttcttttatgtaatagtaacaggttgtgcatacgaacaaaccggcaagcacagtaatcataaggggcgtcatcacttcatcacctgcctgctgtctatcggttcctgcctgaaaatgcccatgaatttgcggcggtccatccaaagcaggataagacacataaccattaatatcgtgctaagatcctgcacgccaatgtcaaaacaatagttaatcaagacgatgttcacaataatgggcataaaaataaccgcccctaatgcagccgttcgcggaatcagtaataaaacagctgccaggatttcaccaaaacctataaacagttcatagacatgagaataaccgaaaaatgtccacgcgatcgtaaaccccttcccggcagccgcctcgatttcaggcgtcacctcgccaaactggccaattaccactttcgccagaccgtacacgaaaaaattaaaggctaaaaacaatcggaacgtcgcgggaatcgacttgcgtaccgctttcctcagcctgccgcctttcttcatcatacatccccctcagtgtattatttgatatagtacacttaatacagtatatagtattctaattaatgtcaattcccttttcagctcatatgaatagctgcttttatagatacaaagtcttatatcgtaaaaaatgtcgttctcctttctttccgtccctcgataacatttcttaaaaaccatgttaggaaatcttacacgaaaatgttttatcattcttttttctctataatgaagaaatataataattgctttttattctgaaagatacggaggaatgagacatgcaaatgggcgatacagtttttatgttcttttgcgctttactcgtgtggctgatgaccccgggattagcgttattttatggaggaatggtaaagagcaaaaatgtgctgagcactgccatgcacagtttctcttccattgccatcgtttccatcgtttgggtgctgttcggatatacacttgccttcgcaccaggcaattcaatcatcggcgggctggagtgggccggcctcaaaggggtcggatttgatccgggagaatacagcgataccatcccccactcgttatttatgatgttccaaatgacgttcgccgttctgactacagcgattatttccggggctttcgcagagcggatgcgattcggcgcttttcttttattctcggttttatgggcctctttggtttacacacccgtagcgcactgggtatggggcggcggctggatcggccagcttggagcgctcgattttgctggcggcaatgttgttcatatttcctccggtgtggcaggacttgttcttgccattgtgctcggcaaacggaaagacggtacagcgtcttctccgcataacctcatttacaccttcttaggaggagctttgatttggttcggctggttcggctttaacgtcggcagcgctttgactttagatggtgtagccatgtacgcgttcatcaacacaaacaccgcggctgcagccgggatcgccggctggatcttagtagaatggattattaacaaaaaaccgacaatgctcggagcggtatctggcgcaatcgccgggcttgtcgccattacgccggctgccggatttgtcacaccgttcgcttctattattatcggcatcatcggcggggcagtttgtttctggggagtattctcgcttaaaaagaaattcggatacgacgacgcgcttgacgcctttggcctgcacgggatcggcggcacatggggcggaatcgcaacaggattattcgcaacaacctctgttaactcagcgggcgcagatgggttattttacggtgatgcaagcttaatctggaaacaaatcgtcgccatcgccgccacttatgtttttgtatttattgtcactttcgttattattaaaattgtaagcctcttccttccccttcgcgcaactgaagaagaagagtcacttgggcttgacttaacgatgcacggggaaaaagcatatcaagattctatgtgaggagtgacgctatgagcggtcaaatgttcaaggtagaaattgtaacgcgtccggcaaattttgaaaagctgaagcaggaactcggaaaaatcggagtgacctctctgactttctccaatgtacacggctgcggccttcaaaaagcacatacggagctctatcgaggggtaaaaatagaaagcaatgtatacgagcgtttaaaaatagaaattgtggtcagcaaggttcctgttgatcaagtgacagagaccgctaaaagggtgctgaaaacgggatcacctggtgacggtaaaatatttgtctatgaaatcagcaatacgatcaacatccgcacaggcgaagaaggacctgaagcactttaatatcggtacgagattcggacactccggatctctttttttgtgcacagaatcccccccagaaaccgcgattcctcttcgaattctcttcaagcgccgttatttcagacaatctctatttttatttgaaacttttcatgagtaagattagtctactaaatataaaaatgtaaaaggtgattatttgaactacgaaatttttaaagcaatccatggactatctcatcacaattcagttctcgattccattatggtcttcatcacggaatatgccattgtcgcctatgcccttatcctattggcaatctggctgttcgggaacacacaaagcagaaaacatgtgctatacgcaggcatcacaggaattgcaggccttgtgatcaactatttgattacgcttgtttatgtcgaaccgcgcccgttcgttgcgcatacagtgcatacactgattccgcatgctgcggatgcttcatttccaagtgaccacacgacaggtgcattagcgatttctattgcgatgcttttcagaaaccgcaaaatcggctggccgcttgtcatttttgggcttttgacaggcttttcgagaatttgggtgggacatcactatccggtagatgtattgggcagcctcgttgtcgccatcattatcgggttccttttctttagattttcagatctgcttcgcccgttcgtcgatttggtcgtgaggatctacgaagccattatcaataaactgacgaaaaaaccaaccgatcaaaatttctaagaaagacaaaagccggcgtctgaaatcaagacagccggctttaatatttctcatacatctcttgttttcttcgcttcgccaacacatataaaccataaaacaacccaattccaacagcatcgatgagcacatcccggatacaaccattcctgctgaagaagagctgaagaacttctgtgaaaaaagcaaacgcaaatgagccggctgcagctgatcttatgctgccccgctgtttccacagcaaatatgtcagcacaaagaaggaaaacgcgtgtccgattttttgaataaacgcttcaggtacagtaagctcagtaaaatccataactaaaaattgagacagatcagggtgcggctgaaaatgaaaagccaccgtttgcgatacgaccatgccgctgaagctttccgtacagacagaaagcaggataaaaaagatccagcctgcgagcaataggcggttcatgacataacctcctttataacgtacgtgcctacatgtaactacatagacggtaaaacaaagcaaaaagtaacagaaaaaaacgcccatcacaaggatagacgttttcttcattaagactgttcagtgtcttctgttgtgctgctttctttagaaccagatttgtcagttgaatcatcctttttctcaccggatttttcttctgttcctttttcagttgatccgtcctttttctcggaagattgctgaatggattcttctgtttcttgggtggcagctttttcttcagcagctgctgctttttcaatagaagaaactggtttgtccataaagtttaacggattcattgcaaccccatctttacggatttcaaagtgcacgtggtttccgctgtcttcactgtaaaggttcttgccagattttccgatcacttgattttgttttactttgtcaccttgctcaacgcttacttcggaaagagattgatacacagtcgataaaccgtcggcatgttctacttccacaacatatcccagcactggatctttttcagctttaacaaccgtaccgctcagagaagcagagacatcgaaatcttttccgtctttctcagctaagtcaattcctttgcttaggctgtacgtgttattataggtaacgagtgctgcttctttctcttcttttgcggcatcggtttcatagaactttttcacaacagaaacgttttcagaatcaacaaccggcattgcgacattttccattgactttcctacttcaactgcatcgtcgttgttgtcatatgcggagtttccgccgttatcagccaactgatcctttacctcatcatttgatactgattgataccaaaggacagctgttaaaatgacggccgcactgactaagtaaattgcagggaacacccagcgtttacgaaaaaactgctgaagttttttgacttgagaagttttcttttcttcctctctcattgtttcatcacctcagcaacattctgaacacttttctgaaaatatatacaacctatccaaaaaaacttttttagatgtagtttgcacagactgaacgaaaatatgtatttttttgagaggagtgccaaaaacgtatgaacatgacattgcgtcttgctgaacatagagacttggaggctgttgtggcgatttataattcaacgattgcttctcgaatggtaacagccgataccgaaccggtaactcctgaagaccggatggaatggttttcgggacatacagagtcacgtccgctctatgtggccgaggatgaaaacggaaacgtcgctgcctggatcagctttgaaacattttatggaaggccagcctataataaaacagcggaagtcagcatatacattgacgaagcatgccgcggcaaaggtgttggatcatatttgcttcaagaagcgctccgcattgccccgaatcttggcatccgctcacttatggccttcattttcgggcataataaaccaagcctgaagctgtttgaaaagcacgggtttgcagaatggggactattccccggcatcgccgaaatggacgggaaaagatacgatttaaaaattttagggagagagctttcatgattagtctggataaagatgaaaacgaaattgaacatcataatgaagaaaatagccttgttgaacaggagactgcacctgttggacaggagagccgccagctgagcgcctccgctgtcaagtcgctatccgacattgccaagtggggcaaaatttctggcatcttgttaatcattatgggatcgcttgtcactctgtctgttttgatgacagtgattggcgccatcccgggcgtgctgctcattatatcaggcgtatttttgatgcgctcagcaaaagcagccgcggaagccgaaggaaatctagccggcagcgctggcgaaagcatgcttgaaaattacgggacatttataaaaatgcagctgttttatgcagcatccagtatcgttactgtcctgatcgggatcattgtagccattttcgtgctggtggtaatcggcattgctgcttttgagaacacgccttcgtatgatgatccggattcttattattatgaggatgatccggtgtttgaataatgatgagacaggacagggcatgagttccatataaacggaaccatgcctattttatttgactattcaaagcaggccggcgtaaacaccaaatcctgaagcaagtacaatagacatctctagtagaagaaatcaacaaagcaacgctgttacccagaaataaataacaaaaaaactacctatgaggtcggaatctatctgaaaccgcgctttttatttcgggtgtctgcatgcaaaaaaacacacccggatcgtctggaaaatctcaacaatccgggtgcagatcttctttaatacatttttttgcgtctgtcttcctcagtcaaaaattcaacaaaactccgcatcgcaaaaggctcttcctttatttgccgtgcgtaggagcttttccgctcttctgaaaggatttcgctctttttgatcctgttcagcatatagatgtgaactgttttttggatttgtttatgctgatagcctgcctctttaaaaaatgcgagcccgagcgccgccaaaagagcgaatatgcctgcgctgatcagggactccctgtcagctgaagcatgaaatagaaaagcagctaaattaaagagagagaatgcagcaagcggaatagcaagaaaacggtaaatgacggtttttttcatgaaaggctgtacggccttttgaattttttgcatttctgttttgatgaaccccggcatttgttcgactctgtaaaagttcatataatcctccccctttatttgatgtttcaagcttcacgaacgttacatatgtgtttattttaacgcaggtgcaagctggttttaaagaaatctgcccgtatttttcacgaagaatctggatcgccgctctttattcttttaaaatgtgagtgttataatttgtaatgggaatcagatcactgttattcatggaatactaatggcaatcttcttgataaatatgaatgagcggggttacaaagtgagtatttcttccatccttttatcactttttttcattttaaatattcttttggccatcattgtcatcttcaaagaacggcgcgatgccagtgcatcttgggcgtggctgcttgttcttttctttattcccgttttaggctttattttatacttattattcggccataatctcagacgcaagcatttgtttcaatgggaagaccggaaaaagattggaattgaaaggctgctgaagcatcagcttgaagatttagaaaccaagcaatttcagtttaacaaccgggcaacctttgataacaaagatttaatttatatgctgattatgaataaccatgctgtgtttacagaggataattcagttgacgtcattacagatggacgggataaatttcagcggctgctgagtgacatttcaaaggctaaggatcatatccatttacagtattatatttataaaggcgatgaattaggcaaaaaattgcgggacgctctcatccaaaaggcgaaagaaggtgttcaggtcagagtgctttatgatgaactcgggtccagaacgctgagaaaaaagttttttaaagagcttcgcgaggctggcgggcatgtggaggtctttttcccgtcaaagctcaggccgattaacctgcggctgaattaccggaaccatcgaaagcttgtgatcatagacggtatgaccggttatgtcggaggctttaacgtcggagatgagtatctagggcttaatccgaaattcggttattggcgggatacgcatatccggctgcaaggaacggccgtacacgccatccaaacacggttcatccttgactggaaccaagcttctcatcaccatacgctgacatatattccaaatcactttcctgattacggcccaaaaggcaacgtcgggatgcagattgtcacaagcggccctgattcggaatgggaacaaattaaaaatggctacatcaaaatgatttcgaacgccaagcgttccattttgatacaaacaccttattttatcccagatgcaagcctgctggatgctttaaggatcgcttgcctttcgggcattgacgttaacattatgattccgaacaagcccgatcatgcctttgtatactgggcaacactttcgtatatcggcgatctgctgaaagccggagccactgtctatatttacgataacggctttattcacgcgaaaaccatcgtggtggatgacgaaatcgcttcagtcggcacagcgaacattgatgtccgaagcttcaggctgaattttgaggttaatgcatttatatacgatatcaccattgctaaaaaactggtttcaacttttaaagaagatttgctagtatccagaaaattcacctatgaggagtatctgcagcgcccgttgtggattcgaataaaagaatccgtctcgcggctgttgtcgccgatcttataagatgtgcaaacccccggcctttacggccgggggttttcctgatggtcacagtaaatgatgatcgcctcccgcaaaaaagcggcaagaccttctccatattgattgattgaatcggtaaatcgctcgtcagtgatatacacttccccgagtcctctgaaaatgtcgagtgtgcaatcgtaatgatattggcaaatatgatcgcgaaatgcccccactgcggcctgaacctctgcatcatcgggcccatgcttcattcgcgccgcaattcgtctgtaaatcgaatcaaattcagccatgatcgagcgccaatcatctgccgagtatgcagatgtccttttctctgtttcttctgcgatttccttaccatacagctttctgacttcgtcagcgtatgtctgctgatgctcttcaatgtctttcatgcttaatccggcaaataaatccctcttattcatcgtttcccctccatcaacggacaaaagcgtcctgtcaattgtttgaatcatctcatccattctttgttttttcttcatcaatatctccttttgcgactgaagtgccgctttccggtcaaaattcggatgatccagcatctccttaatctcatccagacgaaacccgatttccttgaaaaataaaatctgctgcagtctttccaggtctgcgtcactgtacaaacgatacccagcatcagtaagcgctgaaggattcagaagctcaatattgtcatagtgatggagcgtccgaatgctaacacctgatatctccgccacttgtttaacttgatatttcatacataacacctcctcttttttatcgtaaacaatcacgcaacgttagggtcaatccccaaaatgttattttctatatacaaaacttctcacaaatagtgtataaaagaaaagtgagtatttttttgtaaaggggagccagtatacatgaatcctgaaacaatgaacaaaaccctcatcagcatttcgaaatggggaaaagctacaggcattttatttattattatgggcgcaattaccgcgctttcaggcgcgttcttttttctaatcggtgccgtgccaggcgtactgcaaattatttccggtatctttttgatgaggtcagctagggaagcaggccaaatggctgaacacaatagcggacagtctgaagacttaatgctggagaattacgcgaaattcgtaaagatgcaagggatttatttgatcgtaagcattgctgtatccattcttgcgattatcgccttcttcatctttttaatgcttgggattgctgacggccttttcagcgatacgtacagcacttattaatgagaaaaacccggagctggctccgggttttttattattccgcttcgcttaccactgtgaagcgttcatttttgtgttcgggatgttcaagctcgtccaacacggcaatggcataatctgcatagctgatatagctgtcgccttttgcatttacgatgacattgtcttttcctttttggtaagagccagtccgttttcctgctggatcaaaaaatgctgcaggactgaggaacgtccaggaaatgaagtctgtctgctgcaaatctttcaggttctctccttgatttgatgcagttggcaaatattctttcggaaattccggcgtatccattaaacgggttgttttggcttcatcaacaaacaggcttcccgctccgccaacaacaagcaatcttgtgcgcttcgcgtcctttaagatgttgatgagtgctcttcctgcttcaacatgaagatgttcttggccgggtgctgctccaaaagcgtttacgactgcgtcgaaaggcttgatgtcttccgcagtcagttcaaacacatctttttccaaaaccgctacgtcctgcccctgcacttttgaagcgtttctgacgatggctgtcacttcatggcctcttgttttcgcttctttcaaaatttcgtttcccgctttcccgcttgcgcctataataccaattttcatttttcatttcctccttatttgtaacaattttagttacatgttagcggtgagaagtcatcccttttgattaaaagagatgattcataacatcttttaatgacttgcttgccagttcattttccatcgctctttgcacactttcaaacgtttcatccagagcgttctgaatttttttccctaccggacatttcggattcgggttttcatgaaccgcaaagagttcttcttgcttttggacagcccggtacacttctaaaagagaaatatcagcaggatcttttttgaggcttgcacccggcacccctgcgcgtgatgtgagaatatcagcttttttcagcaggctgatcattcttcgcacaactaccggatttgtgttgacactgtcagcaatgatttctgaagatgttttttcatccatcgagatgagggataaaatatgaatggcaacagcaagacggctgttaatcatgttttttcaccaccgttgtaactataatagttacatttgattcgtttgtcaacatctaatatacactaaatacacgggttttgtgcaccgtttttagtcaatagaacggccggatgcactccggccgcgtcttatcaaaataagaaatatctttgtccaagtgggacataatcgacaggctggcaagacaattcctccccgtcagcaaagacctgataggtttttggatcaatctcaatctttggcaaagccgaattcagcttcatatccagcttgctcagctttctgatatttttgactggagaaatccttttttccagccctaagctttctgccacaccacgctctatgcttgcctgagacataaatgtaatcgaggttgagcggttggcttttccgtaagacgcatacatttggcgcatgaaaaccggttcaggagtcgggatggacgcgttcggatctcccatttgcgcacgtgcaatcatgccgccctttaagaccagttccggtttcacgccgaaaaataccgggtcccacagaacgagatcagcaagcttccctttttccaccgagccgacctcatggctgagcccgtgcgtaattgccggattaatcgtgtatttggcaatgtaccgttttgcgcgcacattgtcattcccgttttcaccggcaagagcgccgcgctgttttttcattttatcggctacctgccatgttcggatgatcacttcaccgacccgccccatcgcttgggaatccgatgatgtcatgctgatcgcacctatatcatggagaatatcctccgcggcaatcgtcgccgccctgattctggaatggctgaatgccacatcttcaggcactttcgcatctaaatggtggcagaccatcatcatgtcaagatgctcatccatcgtattaacggtataaggaatggttggcgttgtagatgacggcagaatgttcgcgtaagaggcgagcttcataatatccggagcgtggccgccgcctgccccttcaatgtgataagtatgaataacccggtccccgatcgcgtcgagcgtgttttccaaaaagcccgcttcgttaatcgtatcggtatggatggcaacttgaatatcagcctcgtccacgacttccatacacgttttaatggcgcttggcgtcgtgccccagtcttcatggagcttaaggccgatggcgcctgcttccacctgctcgatcagcggcgctttatcggatgcattcccttttcctaagaagccgacattgatcggaaactcctcggccgcttccagcatcctcgccatataccacgccccggacgtacatgttgtcgctttgcttcctgtagcgggtcctgttccgcctcccaaaagggtcgtcacacctgaagaaagcgcaacttccatctgctgaggacaaataaaatgaatgtgcgtgtccactcccccggctgttaaaattttgccttcaccggaaatcacctctgtccccgctccgatgaccatgtgtggatcgactccatccatgatatcaggatttccgctttttccgacaccgacaatccggccgtctttcacaccgacatccgctttgacaatgcctgtgtaatccaatagcacgacgttggtgataactaaatccaaagcgccgtccttccctgtgattctgccgttttggcccatgccgtcgcggattgtttttccgccgccaaagatcatttcttcaccatatactgtgaaatccttttcgacttcgatccataaatccgtgtcgcccaatctgattttatcgcccgttgtcgggccaaacagttccgcatattcctcccgtgacattttcatcggattacaccctccatccagccggcttgttttaagttggccaacgttttttctttgccgcgttcatcgataaacgtgtcggccattccgttcagccctttaattgtcttgcgtcctctgatttccactagtgagaccgttttctgctctcccggctcaaaacggaccgacgtgcctgatggaacatcaagacgcatgccgatcgccagctcacggtcaaataataaagccccgttggcctccgcaaaatgaaaatgcgaaccgacttgaatggagcgtgatccggtgttttttaccgttacctcccgtatctcacgcccttcattaatcgtaatggttccctcagcaatttgaaatgctcccggcttcatgacttcacctccgcagaaattggctgatgtaccgtaacaagctttactccatccggaaatgtggcctccacctgaatgctgtccagcatctcaggcacaccctccatcacatctttttccgttaatacatggcggccggcttccatcagctctgctactcccttcccatcacgtgcgccttccataataaagcaggtgatataagcagcagcctcaggatagttcagcagaacgccccgcgcctttcgctgtttggctaattcccccgctgcaaaaatgagcaatttctcttgttcaactggtgtcagtttcatctgtagtcctccttcttttgtcatataaagcagatgcggctactacgaatttgcggaacagtcaggcgggacatcacctccctttcttcgggaatgggggtcatacggtaagatgcctttcaaagcggcatgccgtttcttcatcagccttgccatggtcaacaaccgttcccctgtcgatcacggaaagatcagattaacgcgttttccagactgcgctcgactaagataacaaatgtctttttttctggaaatttctataataacttgtctgactagttcgacaattaaaatctgaattccttccaattgtttattaagtaaaatatttttcagatttaccatcagcgctctggcgattgcaagctgctgctgttggccgccttttcgctttgaacaaacgtttgattaaaataaatagcccccctgtttagccggaagcaggcctatggagtggatggccgactccatttcggcctaatacagcgacaatctgccccgggcgaagctaaggctgtgcaaaaccatcgattgatcataaccagacgttacattcctgatggcagcccgttgttttgctccgcaaccggaagtatggcatggaggccagtctgaggcgccgacctccacgataccgagaacccaactattgccattaactccgcatcatggacggtcacttcgctgatcgccaccgttcctcttaatgagtgaagaattccggccttcactgaatccccgcttgtgtcgatatcaactgttttctcgcactcccgtggcttccgacactttcttcggtgcagtacattcagccatcaaaacccctttgtttgatttcttcaaatgatgttataaaagtttacaacttatgtcatcattatatagaagaggcctattaattcaaagaatatttaaaaaatttagttaccttgaccaaatcagcttctttttttgttatatttattcacatcagaaaaagcgaaaaaaaaagacaagaaacatttcgtttcctgcctcttccgtacgattaatctttatctgaaaatttatccttggctttcccgatatccttttggatttcgccttttgccttatcttttttgccttcagcctgcatgtccgttctgtcagccatatctccgactttatccttcacttctcctttggctttattgaagccgcccttcattttgtcttttacactatcgttacccatgttaattctcccctctcaattatgtgtgtacttgttaacttcccgatctgagaggcaataaacattctaatgttatttatcgatttcgtagcgctctccgtaacggagcaccttgtatatcgccagcccgtctgatgactttttctccgaatatcggaccggcagcagggcaaaaaacacataatacgtagaaaaatagacaaactgatagaaaaacacattcggctttaatacactgtgtataatcagcagattgattgcaaaaatcgtgatgaggttaaacaagcagcctcctgcatacacgagtgcatttgagaatcgattgtcaattttcaactccccgtaccggcaaaaagaatcgataaaataaatcgttctgaaccgtatgggtccaattttaagcagcgtttttcccatgcctatatccaacgatccctttccgccaaaaataaaagccataaagctgtgccctgaaacatgtataatctgtacaagcggcagaacaatgaggaaagaccacagaaacttcaccatatcattaaaaccaaacattgaattccccctcacatgcatatctgcatcccaaaacggcttttgttcaaaaaacagtgctgtagcgatttttcctgttctccccggaaataaacgttccgatgctcccctttttttgcataaaaaaaaaccatctgccagcagatggttttgtctcatacttcatataaacaatcgttcctttgaatcatctctctcatgctgaccgctttttcataaaaatacaccgcttctttatattgttcgcgatgactgaaataagaggcagcatctaaagcaaattcttcaatatatacatacaggcccttttcttccatataatcaaatacttcttgaatcatatccaaattgacagattccacatataatgcctgcagaaatttatattttgccagactgaagaagtcgtttcgtttttgggcaatggcaatccctttttcatagtaccgtatcgcggcttcgctatcttgttttttgaaaagaacgcgagtcaggctgaagagcgcttttggaagctgttccagctgataatcctcgaagacaggaagcgctttttcaaagtattcggcggcctgatccagctcccccttgtcatcatagcaattcccgatattataaagggctgatccgatcaaacggggctgtccttccaataaagcaaggcgatacgcgtcatccaaatgctcaagcgctttttcataatttctgtagtctatgtagtttcctgatatgacgaaatggcattgaattcttctgactctataaaaatcgtgagccttatacgtctccagcgcctgtacagcgtggttcatagaaaagtgcgtctgcttcataatataaaagacttccgccactttaaaatgaaattccgctctttcaatttcatcttctacaaacgcaagcatcttctcagctttccgataaaaggatatagccgagatgtaattgttctgttcaaattcgtacattcctctaaacaagtgaaaataatactcagataatccggagatgctgtcctgattgctttccagcgttttgatcaattcacgatattgaagctgagattcctcgtgcaggtcaggctttacgtaatccagcataatttggtgccggtagctgatcagctgataatacaggagaagcagctgatcctcttccatctgttcgatatctagatcaatttcttctttcagctttacggcatcagccacttgaaatgctaaaatgtgcttataccacttattgattttcactcctacttgagatgacgggatctcgtacgcggccatgcccctccaaccctttctattttctaattggttatattttatcataatgtatggctttggaattaaattttcttacaatgattccttctttatgcctatccttatatatttcggtttttctacgtattttttgcactcggattctaataaaaaagcttaccggacagtgccgataagcttttgacttcaaattaaccgccaatataagacatttccactttctttttgccagatgcttttgatagcgtacgatcgactgaatactgatcgatccgatttttccatactgtcccgatcatttctgatagttcgtcatcacttaattcctggcgaaccggagctctgaggtcaaatccgcttgaagcgaataagcaggtaaacagctctcctctcgcagaaagacgggctctgttgcaagatccgcagaacgcatcagatacagatgatatgacgccgatttctccggagccgtccaagtagcggaatctggaagccacttcgcctatataattaggcgctatcggctcaaccggcatgtgttcattgatcaaatctatgatttccgcctttgtcatgacgtcttttttttcccattggttggtgttgcctacgtccataaattcaatgaatctcaggatatgccctttttctttaaaataacgggccataggcagtatatctttttcattgacgcccttttgaacgaccatattgattttaacaccgagccccgcttgcttcgccgcttcaatgccttccagcaccttgctgacagaaacaccgcgcccgtttatcttcttaaaacgctcgtcttctaaagaatcaaggctgatcgtaacccttttcagcccagcctccttgagcctcttagcataaacaggcagcagtgatccgtttgtcgtcatcgcgatgtcacgaatacccggtatgcgggccagttttttgattaattccggcatatcctttctcatgaggggctctccgccggtcaagcggattttttcaacgccaaatcttgtgacaaacaatgtcgcaagccgttccagctcctcaaatgaaagcagctcctctttctttaaaaaaggataatccgggccgaataattcggcgggcatacagtacgtgcatcggaagttgcagcggtctgtaacagaaatgcgaaggtctctcagcggtctgtttcttttatccaacatctgacgcgactctgtaatcatagctacagccccttcctactccctgattctctcagggtgtgtatatacattaaatgatccgtttctgacaaatccaatcgctgtgatattcaattcttcagccatttgaatcgcaagctccgtcggggccgatttggaaatgacaatcgacacgccgattttggccgcttttaacaggacctctgatgagattctgccgctgaacacaatcagtttgtcgcgtacggacatcccgtttagaaggcagtgcccgtatagtttatcaagtgcgttgtgccgaccgatatcggtgcgcatcaacagaagcttctctgtgtcgcaaagcgccgcattatggacgcctcccgtatcctgaaacgtcccgctcccttgctgcatgtctttcataagcgccagacatgcctcaggcgatatcttgatttggctgacagccgtcttggctgttttgacatcctgctgaaaataaaaatgacggccctttccgcagcatgagccgatcacccgtttcgtataatccttttgatccaatgtctcagggtgaacgaggtcgacatatacaaaaccgagactttcatctattgtaaaccttttaatttctttttgaaatcgtataacaccctctgatgcgagaaatccgatgacaagctcttcgatatgctcaggcgtacaaacgagcgtcacaaattcactgccattcagtatcactgtcaaagggaattccgtcaccatccggtcttctactttgcttatttccccttgttcatagcgccatacatccctgaccgcagttactttatcgttcaatgtctcttcccctccgcaatgttcctgcctttatattttttcacactcctcggattttgtcgaattctgagacacaaaaagagccctctatataaagggctttcacaggatgtgatgacggcggtgtttaggcagggcgcctaccgttccttttataacacgtgagcaccaatgtgcattgacaacaaacgcggggtttgtcgacacgctgagagccctctatagaaaggactctatggttgattatactgattcttttttagaaccgtaaacagcacaatagctgcgatcaaggtgagaatgctgacaaaaaagaaggctgccagttttagaagaacaccaagcaatatgaatgcaacggtggctataagaaaaatcattccgaataatttcatatgttcaacccctttttagggtatcattcccgcccaaactgtttttaaaccaataaaaaaaggcgcctgggggagcgcctgatctttaggttccttactcagtaaatttttgtgcttctttttcccaagcctgttcgaactcatccgcactgttcgctgaaatatattctccgccgccagcgacagctgcttgtttcatctcttcattacccttgacatcaaagttgaagccaatgatgtttacaatcgtatccacatttgatgcacggagcttttcgatttctgccgcagggtctccgccgcacgtttcttcaccgtcagtgattaaatacaccacgtttttcccgtctgcgtcaaatgcctcaaattcttttcttgtgtctgcaagtgctttggcaatcggtgtccatccagtcggcttgagctcactcaatgaattgtcaaacagggatccttcatatggatgaaggccgtaaatagtttccgtcgtactgcacgaaagggctttaccggacagtttattattccctgcatgcccgaaaacgcgaagcataagatttgtatccttcggaagaagttcggcaaaagattttactgattttttggcaatgtctattttgcgctctcctcctgttttttgaaccatacttccgcttccgtcaaacaaaacagctacatttgtatcagcctgtttctcagcggcaaaagacggggaggcaatggaaacagtcaacaatccaatgataccggcagccagcaattttttcatatgattacttcctttctttttcatattttccaactatatgttggattcttctttatgctagaatacgaaaatgcaaaaagatataggacatgctgccttttgtgctgctttcacgatctgtccaaaatcgcttgaaatgccgttcatttttagccatttccgcccagaaagcataaacagattgtgtgatcattcattcttttttcgccttgattatgacagaaaaacggaaatctgctactatgctacaggcagacagctaattagttttgaagtttttgttacatacaaaaagaggctgaccatcaccagcctcttttttcttatttagataacattagtgattgctgagtgaaaattttctcaacatctttttgggtataagccgggaagtattcaccgccgcctactttcgcaattgcgttcagctggcctttgtatccctctttataatcaaagccgatcacattaacagtgatattgtctttttgcagttcctttgctgttttaatcgggtttcctccgcacgtttcctcaccgtctgtcaacagatacaccactttttccccttttgcatcaagctggtcaaaagaagatttcgcctcgttcagcgctttggcaattggcgtccagccagtcggcccaattgtattgagagaattgaggaagctttgctcgttaaagctttggaagccgtatacgttgcgaatggcttcacatgactgaacttttccggaatttttattgtttccttcagagccaaacacgctcattttcacctgagttccttctggcagtgagctcgcaaactttgaaatttcttttttggctgaattaaatttagatacaccgtctattcttttcgccatacttccgctggcatcaagcaagaccgccacgttcgccggcgctttagcctccgtttctgacttttcagctgcaaaagcaggtgaagttaatccaaaaagcaatcctgtcatcatgatcagtgaaaatcttttcttcatgttcgtacccctttaccaatttgtttctgcgtgcagatgttcaacgctgaacataatctatcgtaatcaacaaaaaccgagaaataaatagggcgggcttccccattgctgttgtttacttttgcatagaaacctatgtttttattagtgatttccacctaacgcccctatgaaaagagaagattgtccgcctttcggctttcgttatatgagtctgtcgaagtctgtcgacaaatgtggatgactttaccacaatctcaaagcctgaaatcaggaaaaaaggactgatccttaaagacggccagaagctcctctaaaccgtttcagccgctcttagataaaagacattcaagaacagaaaaagacgcccaaagagcgtctttttctactttttcgccatgtatttattcaaaaacgcatctgcctcagaaatttgtgtgccttggtaatagtactttacaatgtcatcaaccgttttgccttctttggccataaaattcgctccgtattggctcatcccaacaccgtggccaaatcctctcgtcgtgactgtaattgtgtctccatttcgcttccattcaaaatcggcggagttgagacccagcttttcacgtatgtctcttcctttcagcgtcttgccgttaatgacggcagttgcgacctggtggcccggtgtctcgccggtaatcttccctactgcgctagatccatccagcttgacgccaagcttttgctgaaattctgccgctgtaaaggttttcgttgccttatatttcggagactttttatcccatgggcttttgacgctttttaaatatgggatagcacttgtccaataagcttctgcattctctgtgtagccgttgcttgtggagaaaaaggatgcttcaatcggctggttgttgtacgttaagattttgccttgcgtactggctaccgcagctgtgattttcttcagttttgtctcatagcttgtgccccactgttttttcagctccgctttgtttttatacacctggaacatctgtgtatcatccaccagtgagcctttaggagcctcaaccgctgaatttgacaccatcagtctgacaataaatgttctggcggcgagggcctgggctttcagtgcttcagattcaaaggttgccggcatttcggaggcgacgactccaatcacatactcttcaagcggaatgttttctacggattgatttgcggttcgatagacgggaatagaaacaggtgatgctttcaatgtttctgctcctttcgatgctggtttcgtgctgactgctgtcttttctgattctacactggcccccgcttccttattatgctggaatggtataaccaagagtgtgggaaccaagagaatcaatgcacatagtacggatagtgtgattgcgaattgtttcatattcagctgcctcctgctcgggattcgactctagtctagtctatgggcagggacaagctaatatgactctcgttttggacagaaactttatttgtcatttacgtattcttttttgctattttgcgcataatgatgataatacacaaaaaataaaaaaccagtatgccagagtgacatactgattttcaagtaagtttatgcatttaagtcagaaacgacttctttattctcttgctcagaagcagactcatcatttacacgttcgatgtctgcgcccagagcggcaagcttctgatggaaatcaacgtaaccgcggtctaagtgcttcaattcagtaacacgtgtgtgaccttcagccactaaccccgcaagaatcagcgctgcacctgcacgcaaatcagtcgctgcaacttcagctccctgaagctgtacaggaccgttaatgatgacagaacgtccttcaatcttgatatcaccattcatacggcggaattcttccgcatgcataaaacggttttcaaaaacggtttctgtaatcatgcttgtgccgcttgcacgaagcagaagcgccatcatttgtgactgcatatcagtcgggaagcccgggtgaggcattgttttgatgtcaatcggtttaagctctttcgggccgatgacacgcagaccttcaccttcatccttaattgttacacccatctcttccatttttgcaattaaagaggtgaggtgttcaggaaccgctccttttactaatacgtttccttcagtgattgcagcagcaaccataaatgtgcccgcttcaatacggtctggaataatatggtgttttacgccgtgaagcttttcgactccttcaattttgatggtgccggtgccagctccgcggatttttccgcccatgccgttgatatagtttgctaaatcaacgatttcgggttcttttgccacgttttccagcgttgttgttccttcagctagagcggctgccataatcaggttctctgtagctcctacacttgggaagtccagataaatttttgcgccttgcagtcggccttttacttcagcttcaatgaagccattaccgactttgatttctgcgcccattgcttcaaaaccttttaaatgctgatcaatcggtctggaaccaattgcgcatccgcccggaagtgcaactcttgcatgacctgtacgcgcaagaagcggccccatgacaagcacagacgcacgcattttacgaacatattcaaaaggtgcttcagtttgcaaagcgtatgaagcatttacagtcacttcattattttcaaaatgcacatctgctcctaaatgacgcaacacttcgttaattgtatatacatcggagagcgtaggtacatcacaaattacgcttttttcttcacttgctaataaagatgcagcgataacaggtaaaacggcatttttagcgccttcaactttgactgtgccgtttaacttctgaccgccgcggacgatgattttttccaaggtattcccctccgcgtccctaaattctctatattaatattcagtcgtaacgattggtgtgccaaccgtaacggtatgttttccgcccattcctgcacttctaagtgcaatttgcaaattcattttatgtttcgaggtcataatgtactcttcccactcatctgtaaacgcagaaatagaaacgaaatttggctcaactacatgttctactgatcttgcttgaaattcatttaataactgatttgcttttttttgcaaaacaatattcatattatcatctaagtgaccatttagacaagtaaaaataactactttttcttggaatatcccaagtgtctcccgttcaaactgttcatatgtatcattccagctatccggtgtctctagactcatttgctcatataataaatacgaagttggattgtgttttttgagggttgtgacaagctgcagtctaaaagaagatcgattttttttgtcagtatatgtgccaattgcctttatcattttatcttcccgtgcaatcacccaatcatattgacgatactctgattttaaacgttgcactttttgataaaattctttttcggtcagtgacatgttttgttttgcatgcaatgtccacttatctattgacacatcttggcgttccatcccctctgccatttgtgctaacggcgttaattcactcgcatgaatggtatggaaaacagcaatgacgaagcttaacatgacggaaatgataatagcgcggcttacttgttttttcttcatgttcatctctcccccttatccccagttttaccggaggcaagaggcgccatacgtaaaaatcttcgtcaaaactcgagctattcgcttcattcaaaacctattaaaatagatagggaagctgctgtgaataattgagataatctaaaaagaaattggcaacggccgttccaatggcaattgtcagcaaaatcatcaggagtcttgcctgcacgactttgccttttttgattaacggatctatattgacggcttgcaacgcccaccaagtcactgctataaaaatcaggtgaacgacaatgccgattgcagcctgctgtcccaatacactcatctattacactcctttctctgcgttcataccctttcttattatataagaagcacagataaagatgatacattttatacagaacggaataatcacccaaatctagggctaatccccgcttaaagtgcgattcttttacatggtatactttattggaaaggagctggcaaatgtgaatcattctttttttcagcctgaaaagcaatatggtgaggacctgccaatttttgatcaggaatgggaagcaattgcattctattatgattatagacagtcacagattgaagaactgaatgaattgtgtcagttttttaacatttctcttacctatacgagagaaagccttgaagagcttgaaaacctctattttcaaagtatacaagaacttttgcttgctgattggaatcttcctattgaagaattcgagaaaatgatcagtgtttatcttatagattgtgtgattgcccgccatgaagatgctgaatgggttgtaaaaccttatccctataaagacggcgcttatacacttggctttagaagacatcgcaaatcgtggcatacaatgaatgcctgtgatggtttatacctgcgtccaaaagaggatcgcccgctgttatcgctgtttgattctcttgtgcgttcataaaaaaatccttctctttatgagaaggattttttcttatttccctgctacatccaatctgttcaaagcccgctgtaacgcaagctcagcccgacgaatgtcagtatcatctgattgagaattcaaacgctcctgcgcccgctggcgtgcagcttcagcgcgctctttatcgatgccttctgctgtctcggcagcctgggcaaggatggtgacctgatcaggacggacttcgacaaatccgccgctgacggcaaccatttcagtctgcccgtcttttttcagacggacagcgccgattttaagaggagccacggttggaatatggcctggcaaaataccgagatcgccgctttcggctctcacactcaccatttcgatatccgcatcgtatactgggccgtcgggagtaacgatattgactttaacggtcttcatgcttttaccctcctaggaccagattaaacttctacacccatttcttttgctttctcaacaacttcttcgatacggcctacaagacggaatgcatcttctggaagatggtcatatttaccggctaagatttctttgaagccttgtaccgtctcttttacaggcacgtaagatcctttttgtccagtgaactgttcagccacgtggaagttctgagaaaggaagaactggatacggcgtgcgcggtgaacgacaagtttgtcttcctcgcctaattcatccataccgagaatcgcaatgatatcctgaagctctttgtaacgctgaagcgttgactgtacttcacgcgcaactgcataatgctcttccccgacaatttcaggagcaagggcgcgtgatgtagatgccaacggatcaaccgcagggtaaatacccatttcagttaatttacgctcaaggtttgttgtcgcatccaagtgagcgaacgttgtcgccggcgccgggtcagtgtagtcatcggcaggcacgtagatcgcctggatagatgtaactgatccaacgttcgtagacgtgatacgctcttggagctgacccatctcagttgcaagcgtcggctgataaccaaccgctgaaggcatacggccaagaagggctgaaacctctgaacccgcttgtgtgaaacggaaaatgttatcgatgaagaacagtacgtcctgtccttgtacatcacggaagtgctcagccattgtaaggcctgtcaaagcaacacgcatacgtgcgcccggcggctcgttcatttgtccgaataccatggctgttttgttgattacgccagagtcactcatttcgtagaaaaggtcgttcccttcacgagtacgctctcctacgccggcgaatacagagataccgccgtgctcttgcgcgatgttgttgattaattcctggattaatacggttttacctacaccggcaccaccgaacaatccgattttaccgcccttaatgtaaggagcaagcaaatcaacaaccttaatacctgtttcaagaatttcaacttctgttgaaagctgatcgaatgaaggcgcctgtctgtgaatcggatcctttttcgcatccgcaggaaccggctcattcaaatcaatattttctccgagaacgttaaatacacgtccaagtgttacatcaccaaccggtactgagattggcgctcctgtatctacagcttccataccgcgctgaacaccatctgtagatgccattgcgattgtacggactgtatcatcacctaaatgaagagcgacctcaagcgttaaatcaatacctacttcgttttcacttgcagctggctgtgaaattttaatcgcattataaatttcaggcaagtgaccgtcttcaaaacgcacgtcgacgaccggtcctaatacctggctaacgcgtcctttcttcatcgctatccctcctgacaaaatctttctattctaaagcggctgctccgccgacaatttccgtaatttcttgtgtgatggctgcttggcgagcgcggttgtaagaaagcgaaagtgaatcgataagttccttcgcgttgtctgtcgcatttttcatcgccgtcattcttgcagcgtgctcacttgctttactgtcaagaagcgcaccgaagattaagctttctgcatattgaggaagcaaaacctccagaacctcctcttcagatggttcaaattcataagacgccgttctttttccgccgccgctgcccaaatcagataacggcagaagttttttctccgttacttcttgagtaatggcgctgacaaaatggttataaacaaggtgcaattcatcaaacgcaccgtctataaacatttgaatcgtttgacgggcaagatctttaatttctgtaaacgttacttcatccccaagtcctgttaactcggaaatgatcggaatctcccgtttcttaaagaaatcacggcccactcttccgatggcaatcaccgcatactcatccttagactgatgacgttcttgcatggcctgataagcactccgtaaaaccgaactgttaaaagcgccggcaagaccgcggtcagacgtaatgacaaggtatgccgtttttttcacttctctgctgagaagcatcgggtgcttcacgttgccggaaactcttccgacgtttgacacaacctcttggattttatccatatatggcacaaatgattttgcattgttttcagcacgattcagcttagccgcagataccatctgcatggcttttgtaatctgacttgtttttttcgttgacgtgatccttgacttaatatcgcgtaatgaggccaaagatttcaccaccttttctcttcatctgcgtaaaaagagagaaaaagagaacctttttctctcatcagcattcgagttagttgcttggtgcaaatgtgcgtttgaagccttcgattgcagcattgaagtcttcatcagcaggaaggtttcctgttttcgcaattccgtcaagcaggtctttatggttttggtcaaggtacatgtagtactcttcttcaaaacgtctgatatccgccacaggaatatcatcgagatatccttttgtcagcgcataaagaatggctacttgcttttcaaccggaagcggcttgttcagatcctgcttcagcacttcaactgtacgcgcaccgcggttcagttttgcctgagtcgcttggtcgaggtcagaaccgaattgagcgaatgcttccagctcacggtatgacgcaaggtcaagacgcaaagtacctgatacttttttcatcgctttgatttgcgctgagccgccgacacgggatacagacaatccggcattgatcgctggacgtacgcctgagaagaacaaatcagattgcaggaagatctgtccgtcggtgatggaaatgacgttcgtcggaatataagcagagatatctccggcttgtgtttctacgaacggcagagctgtaattgatcctgcgcctttcgcgtcgctaagctttgctgcacgctcaagcagacgggaatgaagatagaatacatccccagggaacgcttcacggcctggcggacggcgaagaagcaaggacagctcacggtaagcggccgcttgtttagaaagatcatcgtatacaacaagaacgtgcttgccgttgtacataaattcttctgccattgtaaccccagcatacggtgccaggtacagaagcggtgccggctgtgaggcagacgccgttacaacaattgtataatcaagcgcgccgtgtttacgcaatgtttctactacgccgcggactgttgattctttttggccgatcgcaacatatacgcagatcatgtcttggtctttttggttcaggatcgcatcgatcgcaacagatgttttacctgtttgacggtcaccgatgatcagctcacgctggccgcggccgattggaatcagtgcatcgatcgctttgataccggtttgaagcggttcatgaacggatttacggtccataacgcctggtgcagggctttcaatcggacgagttttgcttgtaaggatcgggccaagtccgtctaccggttggcctagcgggtttacaatacggccgattaactcttcaccaacaggaacctccatgatgcgacctgttctttttacttcgtctccctcacggatctcactgaaaggtcctaagatgacgatacctacgtttgattcttcaaggttttgagccatacccaaaacaccgtttgaaaattcgacaagttcaccggccatacagttgtcaaggccgtgcacacgtgcaataccgtcaccgacttggatgactgtacctacgtcttgaacttcaatatcagattgataattttgtatttgctgttttatcagcgtgctaatctcttcagctttgatgctcacttaggtttcaccccttctatcgattttccccggctaattgacgttcgatgcgctgaagcttcccgcttacgctgccgtcataaatccggtttccaatgcggactttaatgccgcctattaaatccgtctgcacttcatttctgattctcagtgaagcgactccggctttttttgcaaacacttgtgataatggtaacatttctgcatccgtcagcggtttcactgaatatacgattgcgtcttctgtttgacgggccacatttgcgagtttgataaactcatctgtgagctcagggacaatcgcggcacgatggcggtcaatcaaaagaaaaatcgtattgagtacggactgtgacaaagagccaaatgcattttgaatcagctcttttttcttcgcagccggcaccttcggatggttcaacacatcattaagcgctttttcattttgaaatacttgttttacaacaattagctcttcttctacttgattcagctgagcggactcattggctatatcaaaaagagctgatgcatatcgtttagagacagctgatccactcatcggctttctcctacctctttaagatagtcctggatcaatttctcttgcgcttgttcatccagttctttttcgatcactttcgacgcaatcatgacagaaagagacgctacttgctcacggagagcagaaaccgcctgttccttttccttcacgatttcagttcttgctgcttctttcagacgttcagattctgcacgtgcagcctgaataatctcttctttttgcttctctcccagtttctttgcgttttcgataagagtttgggattcctgtcttgcttcttttaaaagaacgcgctgctcttcaatcagctgctgcgcttctttatttttttcttcagcagacgtaatttctccagcgatgtggtcttcacgctgtttcattatgtttaatagcggccctaaagcgtatttcttcagaagcgctaataagattaacatagctaacagttggaacaggatatctccgccgttaaacgacaatcctagttcaagtggtaattgagacatctactacggcaactcccttctgcaggtttttctttgctgatccagcagccgcacttgtctcttttcagccggcaaggcgggatgcttatcagacataaagcaatggcgaaggttctcttggaatgatcttcgccatttttagttcatataaggcttttatgcttagccaaagaacgctaagaatgcgataacgacagcgataataggaagggcttcaactaatgcgatacccatgaacataagagttctcagttctttacctgcttccggctgacgggcaatcccctctaccgtacgtgaaacaatcaaaccgttaccaatacctgcaccaagtgcgcctaaaccaattgcaatcgcagctgctattaaattcatgaaaaagttcctcctttaaaatgttatccgtttggatataatgttttaatgatcatgactgattttatgagacatgtacaccatcgtcagcattgtaaagataaatgcctggatagcaccaataaataaactgaatgcttgccatgccagcatcggcagaatggcaccgattgtaccgacaagaccgagagccacgctttgcgaataatggcttgttgctaatcccgcaagcaggccgagaagaatctcaccggcgaagatgttaccatacagccgcaaacctagagtcagcgtattcgcaaactcttcgatgattttcatcgggagcatgaatggaacaggtcttaaatagtctttggaatattccttgagccctttcatcttcacaccatagtagtgggttaaagcaacaaccatcacggctagcgttaatgtaatggcaggatcggctgtcggagacttccaccagagctcatgtccgattgtaatagagaacggcagccccagcatattcgacacaaatatgtacatcagcaatgtgacaccaagtgccaagaagttagcccctgtttttaaatccattgtactgccaataatattgcggacgaaatcaacaatccattccataaagttctgggcttttccgggacggatcgaaagcgttcttgtcgtcaatatagcaatcaataaaacaatcacactcgccacagtaatcatcagaatgtttgtcagattaaaagtaagacctagaaattctatagttctgtaaccatgattcaaagggttttcacctctcttccattgatgaacgtttaagctggataaaggaatctatcataatgacagggtatattgtcattaatccaataactgtacttgccatatgaaagtattcgggatttttataggcaacagccacagcaagaatcgcattgcaccaccgcgctgcgctcccgagagatcgtatggactttcctttctcaacagctctgtcaaaagcattcattcttctgacgagcagtaaaaaattaaacaaactgaaaacagttcccagaataaggcctaaaaaaacggttttatacgctgttaaaccataacccagtacatacactgccaaaatgaacaataaatatttgcgttgtctgctaaatgtaagcttgggatcgtccatcaattatctgtctcctgatgaaaaaataatgtatagcttggatacggcaaaaatcagcggttaacccttagtagaagaccttttttgaccggcaaaacgggcctgttcgaaaaaatcattcatccgcaagccttgcagggatgctgtttcattcgcttaaataaatcctcataatacgggtttgctgagaggatttacattgaggatgaggactataatgaaagctatgaaaaccttctcataataccctcgtttagcatacaatagcccctaacatgtgtcaatctgtttaaagttaaaaaactttttatactttacgtctccacagaatgttcacattttcacctataattgtatacagattcaccgaatagcaaaaaactggataaaaaaatgaaacccccttttggggatttcattttttattttgttccaaacatgcgatcacccgcatctccgagacctggaacaatatatcctttttcatttaatttttcatctagcgccgcaatgtaaatatcaacgtccgaatgatgcttctgcaattcttccacaccctccggcgctgctacaagacacatgaaacggatatttttcgcaccgcgttttttaaggctgtgaatggcttcaactgcggaaccgcctgtagcgagcatcgggtcaaccacgatgaattcacgctcttccacatcagaaggaagcttgacatagtattccacgggttttaaggtttctggatcacggtaaaggccgacatgtcccacttttgccgcaggaatcagctttaaaatgccgtcaaccattcccaatcctgctctgaggataggaaccactccgagttttttccctgagatgactttcgatttcgcagcctgaaccggtgtattgatatccacttcttccagaggaagatcgcgggtaatttcaaatgccatgagtgtagccacttcatctactaactctctaaaatccttcgtacctgtattttcattccgtatatatgtcagcttgtgctgaattaaaggatgatcaaatacataaacctttcccatactgtgtttcagctccttttttattgtcccatcaacaattacacacttctattgattctacaaaaaaagacattgagtttcaagaacatcgtcaaaaaacccgccgggcataagccccagcgggttttaggatcttaataatctaattctttatataaaggaaatttatcagtcagagcagctacacgctgtcttgcttcttcaagttttccttcgtcttcgtggtttttcaatgcaagcgcaatgatagcaccgacttcttctaatgcgtctccgtcaaaaccacggctggttacagcagctgtcccaagacggatgccgcttgttacgaaaggtttttcaggatcatatggaatcgcgtttttgttagacgtaataccgatttcatcaagtacatgctccgcaaccttaccagtcagtccgagcgaacgaagatcaacaaggataaggtggttgtctgttccgcctgaaacgagctggatgccctctttcgttaaggcttcagccagacgtttcgcgtttgaaatgacgttttgtgcatatgttttgaaatcgtcctgcaatacttcaccgaatgaaacagcttttgcggcaataacgtgcatcagagggccgccttgaattccagggaagatcgatttatcaattttcttgccaaactcttcacggcaaaggatcataccgcctcgaggaccgcgaagtgttttatgtgttgttgttgtaacgaaatcagcgtaaggaaccgggtttggatgaaggcctgccgcaacaagtcctgcgatatgtgccatatccaccatgaagtaagcgccgacttcatcagcaatttcacggaatttcttaaagtcgattgtacgaggatacgcacttgctcctgctacgataagcttcggtttatgagcgagggctttttcacgcacgtcatcgtaatcaatatattgagtttctttatctacgccgtactcaacaaagttatattgaacaccgctgaagttgactgggcttccgtgtgttaaatggccgccgtgggagaggttcatcccaagtacagtatcgccttgctccaaaatcgtgaagtacactgccatgtttgcttgtgcgcctgaatgaggctgaacgtttacatgctccgctccaaagatttccttcgcgcggtcacgggcgatatcttcaacgacatcgacgtgctcgcatccgccgtagtagcgtttgcccggatatccttctgcgtacttatttgtcaaaacagatccttgtgcttccataactgcttcacttacaaagttctcagaagcaatcaattcgatcttagtctgttggcgttcacgctcatttttaatggcgttaaacacttgttcgtcttgcgcaggtaaatgtttcatcagcgagatcctctcctatccgtatcctgttctttgtttttaccatcactattgtacatggtttttaaggccgatgtaaaagattatttttaaaaaatctaaatttttattggtaaaaacgaatattaataacttaaatttaatttaaagttcggaatttatttcactgtcttaaaataaaagaaaagactggctatgcagtcctttcattcacactcataaaccgcccgcactccgccgattagtttcggccgtgtacgcgccaatgtcacatgagctgaaccgaggctgttttgagagacacgcatagggacagccaccggcttcagatgcatgccgataaacgtatcgcctatatcaattccggcgtcagcctgaatggtttcaacaagaacaggagacttcatctgcttaaacgcataagacgccatcgctccgcccgcttttggaacgggcacggcagaaacggttggaagcctgaacagcttggctgtttctgcttcgacgacaagcgctctgtttaaatgctcgcagcattgaaacgccagatggattcccgttttttcccggagctcagcaagtccgctgtagatgctttcagcgatatctacactgcccgatgtgccgatccggctgccggccacttcgctcgtgctgcatccaaggacgaagagctgatcttgtttcaattccgcttggtcctgaaactcagacagcatcgtcttccacgtttgtttcaactcattcattaaacagcacccctacaggtttttctcttcataatcggagatttttccaatacgcgtttggtgtcttcccccggtaaactcagtagtcagccagatttttgcgatttcccgagccaaaccaggtccgatcacccgttcacccatcgcaaggatgtttgtgtcattatgctccctcgtcgccttcgcgctgaaggtatcgtgcgccagcgcgcagcgaatcccttttactttattagcggaaatgctcatgccgatgcctgtcccgcaaattaaaatgcctctgtcaacttcgccgctaaccactttttcggccaccggaaaagcataatccggataatcgacagagccgctgccgcagtcacagcccatatcaatatattcaatttgcaattcgtccattaactctttgatttcatttcgaatgtgaacgccgccatgatccgatgcaatggctactttcatctgcttttcctcccagcgtgtgtgatgcggcccgcccgctttattgaccgcgcagcctgtccgctctttgattcacaccatatgatgtgcttttcactatattctactccttcacgcaggatttgcaaatgacctgtttgcagattttctgacaacttatctacggtcttttttcagctgttttgccagctgccgaagaagctcttcaagctcatctcgcgtttgtttatagatgtcaattgagccgccgaacggatcgaggacatcaccatggctgcctgtgacatattcttttaacgtaaacactttatcacgataacgtccaaattggctggcaatgatctgtttgtgctgatgggtcatagccagaaccaaatcagccgattccataagttcttcagttaatggagaagacacatgattaagggcaatgtgtttttcaaacaacgcttcgactgcatgaggcgtcgctttcccattaggtgaagcaaacacacctgccgagcggacattgacattcagcccttccatttctgcaattgatttaaaaagcgcctcagccattgggctgcggcacgtatttccagtacagacaaaaataatatccatgtcagtcaccccttatttttctctattatatatgaagaaaaaagaaacggcgacttcgtttcttttattggtatattaaattggcaaaagcagctttaatccaaacacgattaatatgatgcccccgagcgcttcgctgtatgtgccaagccatgactgcacttgttttccgaccagcaggcccagccatgtcaacatcatgctgaacagcccgaacagggtaattgtgaggagcggatgcgagccgtatatccccaagctcaagccgacggaaaagctgtcaaggctgacgccgatggcaaacagcaataagcccggccctgccggtgacatgaatcgttcttctgactgtttaaaagaggccataagcatttgaaccccaagaacaaaaagcagcgccccaccgatataaaccgctaacacgccgaggagccctgacagcatgttaccggccgccatccctgcgagaggcatgatgacgtgaaagaggccgatgatgaaaccaatatagaatatctgcttctttctaagtttgaccatgcccattccaaggccgacagaaaaagcatccatccctaaagcaaacgccatgatgcttaatgtaatcagttcgcctataaacaaatccgacatacataaataacccccttggacacgccccgcttttttagcctatgcgtgtccaaaaagggttagaacatctgactgctttcagcgaatcactcttcctccggcggctttcatcagcctgttcataatagcaagaccgacacctgtatccggaaaggattccgctataatgaaatccaccttattctcatcaaagctgcgcaaagcatcatacagccctgccgcaacagtctcaagctgagcccgtcttccgcagctcttcacataatcagcggaataaacgcccgcgttttcttctgtcgtcaggacaccgacccgtcttccgccctgttgatattcttgaatgaggtgctgaatgcgctctgggctgccttcgcaaatggcaagaggcgctgtcggcgcataatgtgtatatttcatccctggagaaatcggcttctcgttttgatcgctgagccctttatccacatggatcggcccgatcacggcctcaatttgttccttcgtaatgccgcccggacgcaggagaacagggatgtcgtccgcacatgaaagcacagttgattcgaccccgattccggtagggcctccatccataataccggctatgcggccatccaagtcgtgagccacatgctccgcttttgtgggacttggcttgcctgatagattggcgctcggtgctgcaatcggcagtcccgattcgcgaatcaatgcaagggcaagcggatgatccggcattctaatggcaaccgtttcaagacctgccgttacacgaggtgaaagcgcatcaggtttgcaaggcagaatgagcgtaagtgctcccggccaaaaccgtttcatcaatgttttcgccttttccggcgccgggcccgttaaatcctcaagctggctgatatccgcaatgtggacaatcaggggattatcgctcggccgccctttcgcctcatatatttttttgacagcatccgtattttttgcgtttgcgcctaggccatatactgtttctgtcggaaaggcaacgacctcattttctcggagcaaagcggctgcttgtgcaatttgtggatcatttgtggataactcgtcagttacatccacaaaccatcttttcgttttcatttctgaccaaactccttattcacaacaataaaacgattgttttacgcgtgtaatccttttgaaagtataaaagatgtcctgtaataaaacaagcgttatccacaaattgtggacaacgctaataaagaagtggataagtatgtgtataaactgcacttatccagacgcttttttcatcaaaacggccccttctgtttgccgcgattcacagaagtgatcagaagaaaacagctcctccggtacactttcagctctttcaaaacccatggccgtcagaaagtccgcagaggaatgctgattcgctactaggtacacggttttgatctgatgcttttcgcacagcacctccatgctttgaaaaagcgtgacgatgtggccttggtgaagcttgtccgatatgacaagtgatcgcagcagcccctggtcacagctgattttttcaataccgaggcatccggcaatgtttttctcactgtcctccagcataagaaattgagtgaagccttctttcacgccttcatagctggttttcgcctgttttaaaaattcctcgagcacatctccgtctttttcccttgccacccgcagttgataaaacatccgttcaccccgtttttgcgttctttcttccaatctatgaggcaaatctatttttagaccagatgattaggaaaaaaggtcggaaatccattcgactaaaaagaatttcacttctgtgccgtcttctttttcttcattctcttcttttttggctttttccgctttagcggttacgtcctcaagcactttttcagtctgcttttttgaggcttctttatcttcttgttctttgacggcttccccgttagaaaaatcgagaaagcagaggggcgggaacagcacacaccaccagttggcgccgtctccgtttccaagcgtaatcaaaatcgcttcatactcaccggcaggatataccatgttgccgtaaagctttgtcggaaacgagattttgtcaaaatcaacggatatcgactgattcgctccttctttctccattgtttcctttgcaattgctttgatttcaggcagctttgaacgaatcacgcgacgcgcttcttcaatagaagtaatatcctttacccaagttgtgatttctttattcaccgcgtctcttatatgacgttttaattgctggtcttgatcactatcgctgtttgccaatattctcaaacgaatcgcctgatccggtatgaccaccggctgattttccgatttctgtgccgtctcttcttttgccagccctacgagcgctccagataataaaagaaagatatatatacaaatgattactgtttttttcatcggtccccaccgttcctctccgtgctttgtttctagccctattatggacaaggagagccgggggtaaacgtgcagggtgaaaaaaatctagcaagctgttaatcttatttatggtacgatagtgttttaggaggtttaagatgaaatacaattatacagtgctgttatcagcattcacgatgtccgttctttattcagtaatttatattcattcatttatcattgccgctctcatcacaatggcattttattttctgtttccttatttgatcttcgcactgccgcttcaaatcatgatgaataaaaagccgaaacggttcagccctttgtatctgctgtattaccttatcgctgcttttattgccaacgcgatcattttcggcgtgcttcagccttcgggacaatctttgtttcaaaatacagccttttatcttttcgctgtattaacagctcttatctattggatatgggattctgttttactgcaaaaaaaggaagcctaagaggcttccttttttattaaaacaaaatcgtcagcaaataacatagaatggaaggtatcgccgcaacaaagaaagcggccgccattttcatgcgagatgtacggccttctttggtttcagaatggtagtttgcccgctgatcgcttccgcttacagccaaacccgatgtaatgatcgcgagccccactaaaacgagagacgcaacgccaaaaatcgcttcatatgaaagagcctgcggaaaaatggtgccaatcatgctctcaatcgcaatgagcaggattcctgctgtcagggcctttttcatgtttacatcccctttgctggtgttaaacagcttgatccattcactcgccagcaagctgcttatttatttttatgaatcagagcgcatatggttctgtcttttccattaatatctttcagcacttccacttccgcccccttaaacgccttgaggatcaggtctttgaccgccgctccctgtttccagccgatttcaaaaacgacaaatactttatccttcataacaagcggaatgtcttccataaaccgcttataaaatttcagcccgtctccgccatcggtgagtgcgtgcagcggctcatgaaaacggacaatttccgataaatcagccatttcttcctctgaaatatatggcgggtttgagacaatgatatccgctttttttcccgccttaataaaaggctcaagcagatcgccctgataaaagcgcacattcgctccgagtttttctgcattggcagaggcgacttgcagcgcctctttcgaaatatcgaccgccgacacagaaaagctttggttttcaagcgcaagcgtgacggctattgcgccgctccctgtaccaacgtcaacaacttcaagcttgccgtcttcagaaaagacactccgatatttttcaagcaaatgaaagacaacttcttcagtttccggccgcgggatcagcacatcatcattcaccataaattcccgtccataaaaaaactcttttcctataatgtattgaaccggcacgccctctttatgcatctcaacgtgacgcttaaagcgatacagttcgtcttcaccaatcggttcctgtaagcttgcgagcagtttgcttctctccattccggtatcataaagcaataggagctcggcagcattttcttctcttcccgcttcggttaaataagaagaagcccatttcagggcttcgaatatcgtcttcatcttaaccttccgactgctgaagcttgcttgcctgatcttcaacaatcagcgcttcaaccacttcgtcaagttttccttcaagaatctgatcaagcttttgaatcgtcaaaccgattctgtgatccgtcacacggttttgcgggaagttgtatgtgcggatacgttcagagcggtcaccagatccgactgctgatttccgtgtttgatcatattcagcctgggcttcctgctgaaatttatcatagattctggcacggagaaccttcattgctttttctttgttcttaatttgagatttttcatcctggcatgatacaactacacctgtcggcaagtgagtcagacgaaccgcagacattgttgtgttaacgctttgtccgcccggtccgcttgaagcaaacgtatcgacacggatatccttctcatggatgtcaacctctacctcttctgcctcaggaagacatgctactgttgcagtggatgtatggatgcgtccgcctgattctgtttccggaacacgctgtacgcggtgggcgccgttttcatatttgagtttagaatacgcgccgcttcccgtaatcataaagatgatctctttgtagccgcccgttccggttacattcgcttccatgacctctgttttccagccctgaagctcagcataacgggaatacattctgtacaggttgcccgcgaataaagcggcttcctcgcctcccgcagccccgcggatctccataataacgtttttgtcgtcattaggatctttcgggatcaggagcaccttcaggcgttctgacagtgtttccgtttccttctgaagttcagaaatctcttccttcaccatgtcgcgcatctcagcatccagcttctcttcaagcatcgcttttgcatcagccagctgttctgacgcatctctgtattgtctatatacgtcaactgtttcttgtatatcagattgctcttttgaatattctcttagctttttcggatcgttgactacttctggatcgctcaaaagctcatttaatttctcgtatcgttcttcaattgattttaaacggtctaacacggtcttcacctctgttttcctgtgcgtaacattctcattatagtatagtgattaaccccagtcaaaagcatttcaatcccagctttaaaagcctcctctgctatactgggaatcgaggagggatattgttgctgaaatccatacatcatattgcaatcatatgttcagattacgaaaagtcgaaagctttctacgtacataagcttggttttcaggtgattcaagaaacgtaccgcgaagagcgcagctcctataagcttgatttgtcgcttaacggctcgtatgtcattgagctgttctcgtttcccgatccgcccgaacgacaaacccggcctgaagccgcaggcctgcgccacctcgcctttacagtcggtagcttggataaagcggttcaggagcttcatgaaaaaggaatcgaaacagagccaatcagaacagacccgctgaccggcaaacgtttcaccttcttttttgatcctgaccagcttccattagaactgtatgaacaataacagtttttgaagaaaaaaaggagatacccactttctttgccgaatcttttcttgttttgtctaacgggaagggaacctcattctatggtcgaatacctagcttaaaaggaggtatgggatcatgaatacaaatatggtagcaagtgaactcggcgtctccgcaaaaacggtgcagcggtgggtgaagcagctgaatctaccggccgaacgcaatgagctcggacactattcgttcacggcagaagacgtgaaggttctaaaatccgttcaaaaacaaatctctgaaggcacggcgattcaggatattcatctgccgaaaagcgctaaaaagcgcacaggcttccttgtccaaaaaacaaatagcgacacagaacgaagaatcgagcagcttgaacaaaagctggacacccttttacagcaaaggcaggacgaaagtgaattgatggcaagaatgtcggaactggaacgccagctgaaacaaaaagccgatgaaggtgtatcttaccagctgcttcagcaccgcagagaaatcgatgatattcttgcagatctgcaatcactgacctcacaaatgaaagaattcaccgctcagccgatccccgagactgctgctgcttctgaaaaaaccaaaacaagaaaaaaaccgctgctgtcactgttcaaatttcaaacctaaagcaaaaagctccccgtaaagggagctttttttgttacgcagtaagcgcgataatgattggaagtgaaatcaatgacagaatcgcactgaccacaaacgcagttgcagtttcttcttcttgtttctcgaaacgagtcgcaatcatggctgcaacggcagaaccagggaatgcaacaagaaggattgcttttgttgtttggtcagccggaagtccgatagcaagagcaatcaggaacattaatgcaggctgaaccgcaacttttagtaacgcaataccgatagccggcatactgagtttaattttacgaataccaacggtaacaccgacagcaaagagagcaacaccagatgttgtgcttccaagctgatcaagcattttaacacccagctcaggaagagtgaaattgaaaaccagcaccaagatcatactgattaacggagcagctgcaagcggctcacaaagaccatgcaggattgattttcctgtcatcttccagaagctgtcgccactctcttcgtttttcttagaagactcaccaacagtagcgataatgatcgcgagcggatcaagaatcgcgttaaccacgatacctgtgaccgcgatcggaatcgcaacttcattcgctccgaataagcttcccaataccgggatacccataaatgcgaatgtcggctgtgcagagttcaaagaaaatacagatgagttcgttaaatcatacttgaaaataaatctgcaaaccaaaagaatgatgatatagaaaccaacaatcccaataattaaagaaatcattaaaggtacttgtgataaaaattcacttctggaagttgtcaaaataccagcgataaagtgagctggaagtgcgtatttcgttactaacgtacttaccccttttgccgacttggcatcataacttccaaaatgtcctgcaaaccaccccagcacgataacaaagaagatcggcgccaggaggattaagatatctaagatgctcaaaatattctcctccaaatcctatgtccgtatactttagctttacaaaaagctttccctcggacagaaaaatttactcgctaattatttcgcgatgacttttttgtattcaggtgtccacattgcttcaagtaccgcttgtttcacatcttcaggctgacgatttgccacgccgtctttaattgctgcttcagcaacggcaatcgcaacttggatagaaacctcttgaagcttatcaatgcttggaagcaatcctgctccaggtgtttcaagatcaaccatttcagcaatcgcatcagcagttgctgcaaacatagcaggtgtaatgatacgcgcttcagctacaattgaaccaagtccaagaccagggaacgcgaatgcgttgttagattgtccgatttcataagaaacaccgttgtattctacattgtcaaatgggcttcctgttgcaataagcacttttccgtcagtccatttgaacagatcttcaggaacagcttcagcaaggtgagtcgggttagacatcggcatgataaccggacggtctacgtgagatgccatttcttttacaatttcctctgtgaatgcacctgaaacccctgaagtaccaatcaagattgttggtttcgcttgacgaacgacttcatcgaatggaatttgacctttttcatcgcgcttccagtctttcacttcatccgcattgcgaaggtaaggtttttggaaatcaaggatgccttcgatgtcttcagtcagcaagcctctgtaatcaagtgtgtagaaacgtttgttagcttcttcttcagataatccggctagcaccattgtgtcacggatttggtcagcaataccgataccagcagaaccagcaccgaagataacaacacgctgatctttaatagaagcgccggttttcttcatagcggcaagcacacctgcaagtgtaatcgcgccagtaccttgaatatcatcattaaatgtcaggatttcatgattgtattttttcatgatgttgcgtgcatttttgttgccaaggtcttcccagtgaagaagcgctttagggaagaatttcaatgcagcttttacataagcgtcaatgaaagcttcgtagcgttcaccttgaacacgttcatgcttgttaccaatatataaaggatcgtttagaagtttttcgttgttcgtaccgacatcaagcacaaccgggataacacggctagggtcaataccagctgcagcagtgtaaacagctaatttaccgattgcgatattaataccgcctacaccccagtcaccgataccgagaatgctttcagagtcagtagcaacgataagatcaatatcgcctgctgtcgcgtgaaggttttcaaacgctttttcaataccgtcaatgttgtcgattgacaagtagattccttgaggtcttctatattcatggctgtactcctgaatcgcttcaccaactgttggtgtgtacacaacaggaagcatttcgcgaagatggtttttcagcaatttatagaaaagaacttcgttacggtttgcaagatcacttaagtaaacattttgacgaaggcggtcaggctgcgcttggaattgctcgtacgcgcgttgtgcttgttgatcaagagaaagtacagttggcggcagaagcccttctaagccgagttcttgtctttcttctagtgaaaaagcaacgcctttatttaaagtaggaatagataaaacttcttttcctctaagagttgtttctaagtggccttctttcgttttttttatgttattcaagcaaatctccttctttcttgaaatagttaaccaagttaagtaataacccatctaaaatatgaccgatcatgatctttatgcgactttgtgacaattattcgaacaatgtctcaaaactatttacattacgtaagctattgtatgcctgtcaaaatcaaaattcaagggaagaaaattacttaattttttaatatacttatttaaattttttaattgcatattatcagaatataaaaaaaacaccggtgtttttagccggtgcattctatctttatacccatgttttggactattttttagatttacctgggacttcgtgatgatgtctgcatcttgcttcatatgattcagatgcaccaaccaaaatgaccggatcatcgtaagaagcaggtttgccgtcaatgaggcgctgtgttctgctcgccggtgatccgcaaacagaacagacggcttgcagctttgtcacactttccgcaatcgccatgatattcgggacgacaccgaacggctctcccctaaaatccatatcaaggcctgctgctatcacacggtagcctttatcggcaagagatgataaaacctcaacaatttcctgatcaaaaaactgcacttcatcaaccgcaatcacatctgtactttcactgatgtgatcccaaatgtccgcagcagacgaaatggcatagctcgtcatcgatgttccattatgggagacaacagcagcttcgctgtatcggttatcaattacaggcttaaataccctgacttcctgcttggcataagttgctctcttcactcttctgatcagctcttcagatttccccgagaacatgctgccgcaaatcagctcaagccacccgctttgtttcattatgtacataggcttcgctcccctctctctgccagctgtgttttagacaatataaaaaacaggcaagactgctgcttgcctgttgagaaatctattattacttaagaccgtattttttgttaaagcgatcaacacgaccatcagcagaagcgaatttttgacggccagtgtagaatgggtggcattcagagcaaatctcaacgcgtacctcttcttttactgagcctgtttcaaattcatttccgcaagcgcatttaactgttgcttttttgaaattaggatgaattcctgctttcattgtatccatctccttccgccctgaatcccgtgtggaaacagagttattatttcggagcattgtccgaaacgcatatgagaaaattatatcagtgatttacttcttttgcaaatacaatttaccttcttgcagatgatagatttgcctgtttccattcttgattgagaatatcgaaaaattcctggtttgttttggtttttttcatttttctcatgaacttttctgcgaaatcaggtgaatcagacatcgttttgcggatagaccataaacgatcaagatgctctttaggcacaagcagctcttctttgcgcgttcctgaacggcggatatcgatagcagggaagatgcggcgctcggcaagagagcggtcaaggtgaagctccatgttgcctgttcccttgaattcttcataaatgacatcatccatacgtgaacctgtatcgaccagagccgtagcaaggatggttaagctgccgccctcttcgatatttctcgcagccccaaagaagcgtttcggacggtggaacgccgctgggtcaatccccccggaaagcgttcttccacttggcggaatcactaagttgtaggcgcgggcaagacgtgtgatgctgtccatcaggataatgacgtcttttttgtgttccacgagacgcatcgcacgttcaagcacaagctcggccactttgatatggttttccggcacttcatcaaacgttgagctgacgacatccccagctacagagcgctcgatatcggttacttcctcaggtctttcgtcaattaaaagcacgatcagctctgcttcaggctggttcgctgtaatgctgttggcaatttccttcagcaacatcgtttttccggctttcggcggcgcaacaatcaatccgcgctgcccaaatccaaccggcgccatcatgtccataattcttgtagacaagaagttcggctttgtttcaagcaccatttgacgatccggataaagtggcgtaagagccgggaaatgcacacgctcttttgcagattcgggatcatccccatttactgcttcaacgtgcaaaagtccatagtaacgctcattttcttttggcgggcgaaccttgccagatactttgtctccgttccgcaaatcgaaacggcggatttgtgaagctgagatgtaaatgtcttctgagcttggagagtagttgatcggtctcaggaatccgaaaccttcagactggatgatctcgagaacgccttccataaacagcagatcttcctgttctgcattcgctttcagaatggcgaaaatgagttctttttttgtcagtttgctgtaataggagattttataatgtcttgcaagttcataaagctctttcaatttcatattttccaaagaggaaatagatacgtctttcataaaaacaccacgcttttcatagtcaatatcttactctgaacatgtcatctgctgcttttgcacaacatccgccaaagcacattctttttttaacataaaggaacttctatcggtaacacttccacccatgatcggcgcttttgttaaaaggattgtcttaatgagttttgaaggaagcgaggacaaaaacatgagaagatcaatacttatatcgtctgtatgcggtagaaattgaaactttcctagtgcttaaaagaaggtattacgcagtaaaattcgcagcactctttatttttaccttatttcaaaaaattattcaactgaaataaggttttgacacggaattgatagagttgacgcttttctgcaaaagttaaagcgggctcacacccgctttttctgtttgttatggacggattacaagatttggtttctttttcaagctgtgtctgccgtcaacgaaacgaacagtgcccgattttgcacggataactaagctttcagttgtaccgacagagcctttgaattgaactccttttaacagctcgccgtcagtaacccctgtagctgcaaaaatcgcgtcatcacccttcacaaggtcttccatgcgaaggactttgcttaaatcaaggcccattttgtgacagcgagtgatttcttcttcgctttgcggaagaagtttaccaatgatttctccgccgagtgctttcagcgcaacagctgaaagcacaccctcaggagcgccgcctgatccgaacaggatatcaacgcccgtgtggtcgaaagccgtgttgatggcgcctgcgacatcgccgtcattgatcaatttgattctggcgccggcctcacgaagctcggaaatgattttttcgtgtctttcacggtttaaaattgtggcaacgacgtcctcaacgtccttgtttttcgcttttgccaccgctttaaggttgtcaatgacaggtgcttcgatgtcaatgcagcccaccgcttccggaccgactgcgattttttgcatatacatgtcaggagcattcagcagagtgccgtggtctgcgaccgcgatcaccgtcagcgcgttccagccgccgcttgctaagatgtttgtgccttcaagagggtcaactgcgacatccacgcgagggccgtacccgtttccgagtttttccccgatatacagcatcggcgcttcgtccatttccccttcaccgattacaacggtccctttcatcggcactgtatcaaaaacgtctctcattgcacttgttgccgcttcatcagcctcatcttttttcccccggcccatccatcttgctgatgccaatgccgcagcttcggtcacacgtaccaattccattgataaacttctttccatttcaacacgatctcctctcacaagaaaccattatgaattttgaagctgttctatttcttcgtcagtcattctttcccgccaaattgtcgctccaagcccctcaagcttcttctcaaggctgctgtatccgcggtcaatatgctccagtcccgtaatttccgtgacgccatcagccatcagtccggctaccaccaagcaggctccggcacgcagatcactcgccttcacttttgcgccttgaagctcaacaggacctgtgatgatggcagatctgccttctactttcatattggcacccattcgtctcagctcatcaatgtgcttgaatcttgccgagtagatggtgtctgtgacgacactcgtccctttcgcccttgtcaggagcgccgtcatcggctgctgtaaatcagtcggaaaccccgggtatacgagggttttgacgtcaaccggctttaagttcttctgcccgccgacaatgaggagctggtcgtcgcttgtttcgatatgatagcccatttctctcaactttgccgttaacgactctagatgagtgggaatgacgttatcgataatgacttccttgcccattgcagcccctgcaatcataaatgtcccggcttcaattctgtccggaatgatcgtatgcttgcagccgtgcagttccttcacgccgtcgattcgaatcacattggtgcccgcacctttgattttggcgcccatgctggtaagcaatgtcgcgacgtcaatgatctcaggctccttggcagcgttttcgatgatcgttttcccttctgccaaaacagcggcgagcataatgttaatcgttgccccaacgcttacgacatctaaataaatccgtgcgcctctcagcctttcagctcgcaaataaatggcgccttgttcattggttacttcagctccgagtgcttcaaagcctttgatatgctgatcaatcggacggggccctaagtgacagccgccaggcaatccaatgaccgcctgcttgaagcggccgagcatcgcccccattaaataatatgacgcgcgaagcttttttactttcccgttaggaagcggcatgctgatcatcgacgtagggtcaacaaccatttccccattctcaaaatgcacgtggccgccgatttcctttaacaggtcacgcagcgtttcaatatctgaaatctctggaagcccttcaattgtcacctcggaatttgccaaaatggttgcaggtattaacgcaacagcgctgtttttagcgccgctgatatgtactgtaccgtttaacgagtcaccgccggcaatattcaacttttccatgatagtctccttccataagaagatagctgcggagctaaataaaatgtcattttattctgtctctgcaaataaagctcatgtccaaaatctagccaattcgaagagaaagaatacaacacattgtaaaatatcaggaagaaaatagcgaagctttggggggtacaggtttcaaaagatgcacagagacccgccggctcgagagacatcgtcgtcatccggcaaaagcagtacgcatacccttcattccgatatcagcttctgcagcccaatgattccttctctgtaaagcggcgtcagcatctgaagatccgctgtatcaggtcggtgaaatacaaaggccgcggcaaacaggcataaagctgtttgccgcccctttcattatttgttccagtctgccaggaattgttcgattcctttgtctgttaacgggtgtttagtgagcgcatgaatgactttcagcggcattgtgccgatatgagcccctctaagagcagcttctgtcacgtgctgcggatggcggattgacgctgcaatgatttgcgtgtcaaggccgtgaatgtcaaaaatctgtttaacttctgaaatcaggtcaagcccgttgtggccgatgtcatctaaacgtcccaggaatggagatacatatgttgcccccgctctggcagcaagaagcgcctggttggcattgaagatcaatgtaacgtttgttttgatgcctaagtcagtaagtgctcttaccgcttttaaaccgtcagacgtcatcgggattttcaccgtaatgttcggagcgatcttcgccagttcttttccttcctcgatcatttcctcagctttcaaagaaataacctctgcgcttacagaccctttcacgacgtctgtgatctcgcgaagacggtcgtggaatgatacgttagcttcctttgctactaaactaggattcgtcgttacaccggcgagaattcctaattcattcgcttctctaatttcatcgatattggctgtatcaacaaagaataacattttcaaaaagcctccctgattaagaaattttctgaactgtgaatatgattgcgctttctaaagatagacggaaaaccgcctgtcaagctgtcaggcggctataaaaagttccaattgaattaagcttggtttgaagaaccaaattcacgcattttaccgataactgtttctttgatcgcttcacgagctggtccaaggtatttacgtggatcgtactcgtcaggcttagctgccaatgtttcgcgaacagcttttgcagaagaaatttggttttcagtattcacgttgattttagctgtaccaagtgaaattgattttttgatgtcagcagtcggaattccagtaccgccgtgaagaactagcggaagaccagttgattttccgatctcttccatttctttgaagccaaggtttggctcacctttgtaagggccgtgaacagaacctaatgcaggtgcaaggcagtcgatgccagtgcgctcaacaagctcttggcactctttaggatcagcgtagattacgccttcagcgataacgtcatcttcttgtccgcctactgttccaagctcagcttctacagatactccgtggaaatgagcaagctcaacaactttagcagttgttgctacgttttcttcaaatggatggtgagaagcgtcgatcattacagatgtgaaacctgcatgaatcgctttcgcacaagattcaaagcttgaaccatggtctaagtgaatcgcaacaggaactgtcactttgtactcttccataagtgcttttaccatagcaacgactgttttgaagccgcccatgtagcgtcccgcaccttcggaaacaccaaggatcactggagatttttcttcttcagctgcttgtaaaatcgcttgagtaaactcaaggttgtttaagttaaattgtcctacagcgtaccctttttctttagctgtattcaacatttccgtcatagaaactaaaggcatgtcgaatgtcctccttatgtagcctgattgtcttctagcgaaaaaagctttccaccctagcatgacccatatattgctgtcatatgtaaatactcagatcgctttttctccataactaggataccaacttttcgacaaatcggcaacataatgacatgattcatttgtttcttctttttgtcagttagacttcaggggcagatattttttgacggcgtctctgatttcgtcgatgtcaaacggcttggcgaagtgcgtcagagcgcccaattccttcgattcctggatcatgtcgagctctccgtatgccgtcatgataatgacccggatgttttcgtcaatgaccttcatccgttttaagatttcgattccgtccatgccgggaattttcatgtccaaaagcacaaggtcgggccgttcttttgtcacaatgtcaagcgcctgcaggccgttcgcagcctgaaacgtctggtagccttctttattgaacacttcatttagcaaaatacgaatgccgtattgatcatcaacgattaaaattttttcattcatcattttacaccccaatattatgattttcgtcaaaagtaagcagtattgtatgtattctgtttgattttcctatttcctttaattataatagtctactttacgacattttctgagcattttctcttttgttgtatactgatattgtacgttataaaggaggattcacttatgttgaaaatattcacgacgcagttaacaggtattttttcccgcattcaggataaggaatctgacgcgattgaagatggggcgcggctgcttgctcaagcggtgatcagcgggcattccatttatttatacggagcaaatgagctgcagggcgtcttttttgaggccactgaaagcaaagaacccttcccatctgtcaaagcctttccagaaagcgctgaggaagtgacagaaagcgacagggtgctgatgttttgctcagggacgggcacagccgaagaacaggcgctctcaaaagagctttatgaaaaaggtgcgggagtcgtatgcgtatcgcccgcagccaaagacagtgcgggaatagaacagtattgtgatgtgcatattgattctaaactaaaaatgccgcttgttccggatgaagacggcacccgttacgggtttccctctttaatgacagcactgtatgtctatcacgctttatcgtttacactaaaagaaattctgcaagagtatgcataatatcttattgtacatgctggaacttgccggaaacaaataaaaaagacttgcccgcttttgacaaacggcaagtcttttttattacttctgatttgcagcttcgacagacgctccgataaagcctttgaatagaggctgaggtcttgtcggtcttgacttgaactctgggtggaactgagaagccacgaaccaagggtggtctttcagctcgatgatttcaacaaggcgtccatcagggcttgtgcctgagaatacaaagccttgctcttccatttgctgtctgaattcattgttaaactcatagcggtggcggtggcgctcgtacaccacttcatcctgatacacttcaaaggctttcgtgccttcttcaagcttacaagggtaaaggccgagacgaagcgttcccccgagatcctccacatccttttgttcaggaagaagatcaatgatcgggtattgagttgacggatcaatttccgctgagtgggcgccttttaagcccaatacgtttcgtgcgtattcaatagacgccacctgcatgcccaagcaaatgcccaagaacggaatgttgttttcgcgcgcgtattttgtcgcgacgattttaccttcaacaccgcggtctccgaatccgcccggcacaatgatgccgtctgttccgcttgtgagttctgcgatattgttttctgtcacttcttccgcgttgatccatttcacttttacatctgcgtcaaacgcatagcccgcatggcggagagactcgacaacagaaatgtatgcgtcaggaagctcaacgtatttgccgacaaggccgattgtaatcgtttgagacaggttgctgactttgttaacaagctctttccattcggacatttccgcttctttgcatgccaatttcatgtgctcgcaaacaagcttatcaagcccttgtttttgaagctccagcggaatggagtaaaggttgtccgcatcttcacattcaataaccgcttttgtatcgatgtcgcagaatagcgcgattttatctttcatatcttgagaaatcggcatttctgtacgaacgacgatgatgtttggctgaatgcccaagctgcgcaattcttttacgctgtgctgtgtcggttttgtttttaattcgccagcagctttaatgtaaggtacgagcgtacagtggatgtacattacgttttcacggccgatgtcgctcttcatttggcggatcgcttcaaggaatggcagtgattcgatgtctccgacagtaccgccgatttctgtaatgacaacatctgcgtttgtctctttccctgcgcggtaaacacggtctttcaattcgtttgtgatgtgcggaatgacctgtacggttccgccaaggtaatctccgcggcgttcttttttaagaactgttgaatagattttacctgttgtcacgttgctgaatttattcaggttaatgtcgataaaacgctcatagtgaccaaggtccaagtctgtttcagcgccgtcatccgttacgaatacttcaccgtgctggtacgggctcattgttcccgggtcaacgttgatgtatggatcgaatttttgaatcgtcacgttcagtccgcggtttttcagcaaacgccctaatgaagctgctacaataccctttccaagtgaggatacaactcccccggttacaaaaatatatttcgtcatttcgtttgctcctctcttcgctcttagctacatttttaaaatgtactattttataaaaaatcatttagccttttaaatgatttataagaaaaatgaggggtgaaaataagaaagctccctttcaatttcttgaaagggagcataacgtactatgttctctcttcgtttttgaagagcccaaaatacatactacctagttcgactatgaaagtcaagatcgttttgaagatgaaatctgatactatttaatttcctcttcttcatcatcatagtcttcatcatcttcatcaataatatcttcttcgatctcaagatcatcgtcgtcttcatcaagatcttcttcgtcaaaatcgtcggcttcaagatcgagttcttcctcaacttcatccaaatcaaggtcgtcttcgtcgatctcttcaaactcgtcaagatcaagatcttcttcgactgctttcttcgcttttttctttttcgccttgactgtcggctgagtttcttcatcaagctgatcatacggataccagctgcgaagcccccacgtctggtcagaaagcgccaggaagcggccgtcaatgtttaaatctgtataaaattgagcaatgcggtctccaagctcttcttttttcacgccgagcaaagatgcgatttcatttaaaagctcctgaaaaggaactggttttttatgttcttcaaataattcgtgagcgatttcaactaaagccatttcctttagctcttcctgtgaatattgtttgatacccaaggtcggacactccctttctattacttatatgtatctgttttatcaataatgaaagcgattttgtatcgttcttatacaaaccatacctctcattataaacaaaataaaacagaatatgctacccttaacagcgttaatttaaataattttacaagagtgatccgactgagagatgttttccgttaatccgcgagcattctggagatgaccagtctttgaatttcttgagtgccttcatagatttgcgtgatttttgcatcacgcatatagcgttctaccggataatcttttgtatagccgtagccgccgaaaatctgcactgcttcggtcgttaccttcatcgccgtatctccagccatcagtttggacatggcggaagcttttccatatgggaggcccgatgattctaaccacgcagcctgataggtcaatagccttgaagcttctatcattgtcgccatatccgcgagtttaaaagcgacgccctgctgctcggcgatcgattttccgaattgctttcgctcttttgcatattgaagcgccgcatcaagcgctccttgggcgatgcctacggcttgtgcagctatgccgtttctgcctccgtcaagcgtcttcatcgcgattttgaagccttctccttcttctccgagacgctttgatgcgggcactacacaatcttcgaacatgatttccgttgtcggtgaagaacggatgcccagcttcttttctttcttgcctgtaaaaaatccttcaaaatccttttctactataaaagcggtaatgccttttttctttttctcgggatcggtgacggcaaaaacaatgtaaatatcagcaacgccgccgtttgtgataaacactttggaaccatttaacacatagtcatcgccgattcgttcagcagttgttttcatgctgccggcgtcagagccagaccctgcttcggtcaaagcgaatgcgccgattttctctccgagggccagctgtgttaagtactctgtcttctgttcctctgtcccaaaggcaaacagcggccagctgcaaagagagatatgggcggaaagcgtcacaccggtggaggcgcacacttttgacagctcctccaccgcgataacgtaggccaaatagtcacttccgattccgccgtaatcttcaggccacggaattcccgtcagccccagatttgccatttcccgaaacaactcgcgatcgaagcgttcttgttcgtcccgttctgccgctgtcggggccacctcatgcttcgcaaaatcgcgcaccaattttcgtatcatctggtgttcttctgataatgaaaaattcattgcttctcccccattttcagatcagcgcctaaaacggattgagccagaagctcgacgacatcgtacgttttgacttggtcttcggcttccttcgcctttgtgccgtccccaagcatcgtgagacaatacggacagccagaactgatcaccgatgggttgactgcgagcgcttgctctgtcctggcgacgttaatcctgttgcctgtttcttcctccatccacattaatcccccgccggctccgcagcacatgccggtttcccggtttctctccatttcaacaagctgcacgcccggaatggctttcaaaatctctctcggcggatcatagacttcattgtaccggcccaaatagcacgaatcatggaaggtaatcgtctcatgaagcgggtgctgcggtcttaattttccgtttttcacaagctcggccagcacttctgtatgatgataaacctcgccttcaaatccgaaatccggatattcgtttttaaataaattgtatgcatggggatcgatcgtaacgatttttttgacatcatttttttcaaattcagaaatattcttctcagccagctcttggaacaaaaattcatttccgaggcggcgcggcgtgtctcctgaatttttttctttattgccgaggatcgcgaaggacacgcccgcgtgattgagcagcttggcaaaggaaattgcgattttctggcttctgttgtcgtaagaccccatggagcctacccagaaaaggtactcaaattcttttccttcttttttcatttcttttacagtcggaatctcagcatccggcgcctcgtcacgccaattttcacgttccttgcggttgagtccccacggattcccttgccgctcaatacttgtcattgcgcgctgggcgtcactgtccatttttccttctgtcagtacgaggtagcggcggaggtcgatgattttatccacgtgctcattcatgaccgggcattgatcctcacagtttcggcaagtggtgcatgcccaaatttcttcctctgtgatgacgtcgccgatcaagcttggattgtaatcaagcgccgctgcggcttcctgcgatccgctgcccgctgacgaagcagccagctgattgcctctcgtatgccgaaacgctgctgcgggcacccatggggagcgcgaggtgacggcagcgcctttttccgtgagatggtctctgagacgcaaaatcaagtccatcggagaaagcatttttccggtgcctgttgcaggacacatatttgtacagcggccgcactcgacacacgcgtacagatcaagcagctgagaccgtctgaaatcctcaatttttcccgctccgtagctttctttcgtttcgtcggtaaaatcaattttttcaagttttccggcagattccattcgattgaaaaagacgtttgccgggccggcgattaaatgggcatgcttcgactgaggcacgtacactaaaaagctaagcaagaacagaagatggatccaccatgcgatatagaaaatcaccgccgcgcctgttttcccgacaccgctaagcataaacgcaatacctgaggcaattggctcgctccaagaaagcccatgctcatgccaaatcagattcatcccgttcccaagcagaacggtcagcattaatcctccgataaaaatgagaacgagtccggctttgaaaccgcgtttcagcctcacgagcttttcgatataacgtctgtagaatgcccacccaacagcaattaaaatgagaaacgtaacaatttcctgaaaaaaggtgaaggcgggatagaccgggccaagcggcagattccggccgggagccagtcctttgatgataaagtcaattgctccgaactgaaccaatataaatccgtagaaaaacatgacgtgaatgattccgcttttcttgtccttgagcagttttttctgtccgaatacattcacccatatggcgtgaagcctttccttgaaccgttgatcaaattgttctttctggccgagcttgatgtaggccagtctcgttttgaccaagtacacaaacaaatagacaacgtaagcggttacaatcagaaataataatgcatttgcgatgagaaagccgctcattccaattccccctttttactgataaagaccgcgatcccctacccccgaatctgtataagattatctttatgataaataatgaatgagtgttcagtcaataattaaattcctgctgttcgggcacactacctttactacggaaaggagtgccggtatgaaggtatttatcgtgattatgatcattgtcgttattttctttgccttgattctgcttgatatcttcatgggccgtgccggatacagaaaaaaggcgtacgagcctgttttttcaaaaaagaagagtgacatcgaattgatccactgcggcgctgatctcgttgagcggatgatgaatgatattcgccaggccgcctcttctgttcacatgatgttttttattatgaaaaatgatgaggtcagccacaatatgtataccttgctgaaaacaaaagcccaagctggcgtatccgtttatttgcttctggattgggcgggctgccgggcaattaaaaaaacggcgctgcagacgatgaaaaatgccggcgtccatgtccatgtgatgaatcgtccccgttttccttttttcttttttcacatgcaaaaacggaatcaccggaagattacggtgatagacggaaaaatcggttatatcggcgggtttaatatcgccgaagaatatcttggaaagaaagcgaagttcggcaattgggaggattatcatctgcgcatgatcggagaaggcgtacatgatcttcaaacgctttttgcttctgatctaaaacgaaataccggaatcgaactgggttcggatgtttggccaaagcttcagcaagggactatttctcacaagatatatgcgaccgacggttattcccttgaaaacatatacttggccaacattgcccaagcgaagaatcgccttacggtttgcacgccttattacattccatcaaaaccgcttcaagaggcccttattaacgcaagaaaaaacggcgtatccgtgagaatcattgtaccgatgaaatcagaccatccgctggtacgagaagcagcttttacgtattattcggagctcttggatgccggctgccttatttatcgttattatcaagggttttatcatgtaaaagccctcatcatagacgaccatctcagcattatcggaacagccaacttcgataaacgaagcctgttcttaaatgaagaggtgaatgttgaaattgatgacgaagcgtttacaagtgaagtctatgccacaattgaggaggatatgaaaaagtcggagctgctgacgatggaggatttcagcaagcgcacattcaggcagcgcccggcggaatggctcggcagggcattatcttatttcttataaaggagagttcctatgattttcagattcgggttcgtttcaaatgcgatgagcctttgggatgcgtctcccgctaaaacattgacattcgcgcgttattcaaagctttcaaagactgaaagaaaagaagcgcttctgactgtgacaaaagccaatttgcgcaatacgatgagaacccttcactatatcatcggccacggcattcctttgtaccgtttttccagttcgattgtgccgctggctacgcatcccgacgtgatgtgggattttgtaacaccgtttcaaaaagagtttcgggagattggagagcttgttaaaacccatcaactgcgaacaagctttcatccaaatcaattcactctgtttacgagcccgaaggaatccgtcacaaaaaatgcggtaaccgatatggcgtatcactaccgcatgcttgaggccatgggcattgctgatcgctccgttatcaacattcatattggcggcgcttacggaaataaagacaccgccactgcacaatttcatcaaaatataaaacggctgccgcaggagatcaaagagcggatgacacttgaaaatgatgataaaacatatacaacggaagaaacgcttcaggtctgtgagcaggaggatgttccgtttgtctttgactttcatcatttttacgccaatccagacgatcacgccgacctgaatgaagcactgccccgcatgatcaaaacgtgggagcggatcggccttcagccaaaggttcacttgtcttccccaaaatcggagcaagcgatacgcagccacgccgattatgttgacgccaactttttgctgccactgttggaacgctttaggcaatggggaactaatattgatttcatgattgaagcaaagcagaaagacaaggcgcttctccgcttgatggatgaattaagctccatccgcggtgtcaaacgcatcgggggcggtgcgctgcaatggaagtcataaatgtgcaaaaataggtttacgacttgtcagctttgggaacttaggctatataagacaacaatcgatggaggagaaagatcatgaaaaatatcaagtctctgaaagtagccgcacaggcctttactttaagaaatttgattcatctttataaaatgtgccattccggaagccacgaggtttatatttattcaaagaaaacgatgtgcaaaatcaaaagcttaattgagcttgaaacgttccgcatggctcataatgaaaaggaatatctgatcgtagttgaaggaacaaaagcatcacagctcattgaaaaattccaaaatctcatcgagcctgctgagagagaagcgctctaacttacatacaaaaaaggatagacatctgtctatcctttttcttatgctcttacataatggagctgaaccgcttgtccaaattgttttgtcccttttaaccgcagttttgtttcatttgttagttcgtgaaacagcgggatgccgcttcctaaaacgacgggaataacagtgatgatgaattcgtcgatggcatcttctttcataaagtcattcacaagctctgccccgccagctatccagatgtttgagcctttttcctgtttcaaacgggcagtgaaggctctggctccctcattgataaacgtcacatgttcatcttgataactgtcgggcgatcctgtaaaaacatagcaggttttatcctgatacgggaaaaccggtgttagcactttaacgtgctcatatgtgctccgccctaaaatgactgtatcaacagtctgataaaaatcactgtagccgttgtcaccttcaccttcaaattcatccagccaatcgatgcttccatcttcttttgcgatcatcccgtccaatgaaacagcaatgtacagcacagtttttctttccatgttctcctcctatcgatgcaccatttgcccgaattgcgcttgatgcagcctgctgtataggcctccggcttcgatcaggtcttgatgacggccttgttcttcaataccgttgtttgtgacgactacaattctgtccgcgtctttgattgttgccagcctgtgggcgatgacaagcgtcgtgcgcccctcagacaactcttgaagcgccttttggatcgccgcttccgtctctgtatcaagggctgaggtggcttcgtcgagaatcaagatcgacggatttttcaagaacatccttgcaattgacagacgctgtttttgcccgccggaaagcttcacgccgcgttcgccaatcatagtatccaacccatcgggcatgttatggacgagctcttccagatgcgcctgcttcacagcttgccaaatgtcttcttctgatgcgcctagtcggccgtaggcgatattttctctaagcgtgcccgagaataagaaaacgtcctgctgcacgacgccaatctgcccgcgcaacgaagaaagcgtcatgtcttttatactgatgccgtcaatcgtaatgtcgccctccgatgcttcataaaaacgcggaagcagactgcaaagcgttgatttcccagcacctgacggaccgacgaacgccaccgtttcccccgcttgaatggataggttgatgtcattgaggacattgtgatggtcatcatagccaaacgaaacatgtttatagcggatattgcccttcaggccggaaacatctctcgcatcaggtgaatcctgaatgtccggctctgtctccatgagctccatatagcttttgaaacccgcgatccccctcggatacatttcgataatggcattaattttgtcaataggcctgaacagcacatttgtcaggagcacaaacgccacaaattccccgtacgataaggagccgcgaatgacaaaccacgtcccgcacaaaaggacaaacagcgtgacaaaccgggtcagcatatagctgattgacccgtttttcgccatgattttgtaggaagaaagctttgtgacacgaaaacgctggttgttgacggcgaagcgttctttttcaaacgcttcatttccgaacgcctgcacaagccggatgccgccgatgttattttctacacgcgcgctgaagtctccgatatccttgttcagcgtggtaaatgctttggtcatttttttgttgaaataaagcgctagccaaatgacgatcggcataatgataaacgttaataaagcaagctgccagttaataaacagcatcactccgaacgccccgagaatggtcatgaccgcaatgaataagtcttccggaccgtgatgggcgacttcaccgatatacattaaatcgttcgtaagcttcgacatcagcgttcccgtcttgttgttgtcgtaaaatttgaacgagagcttttgcaaatggtcaaaaagcgactttctcatatcagtctcaatattgataccaagcatgtgtccccagtaggtcacgatatactgaagagccgagctgagcgcgtacaccgcaaataacccgattgaggtcgcgatgatcagcccccagtccctgcccggcagcaaggtatcaataaaataattgacaatcaaaggaaaactcagctccattaaacctcccgcgatcgctgagaaaaagtcgagaaagaacaacgttttatatggtttataatatgaaaaaaattgccgcagcaccctatcttcccccaatgtataaataactgataatatttctcaattatactatacacgggctgttttgaaagatcagatttcttttttcttacagaacacctgaaaacaggcgggcaaatgactcttttgtccggtcagccacgcctcttttataaaagccgacagggctgagcttttcactttcctgcatatcctcttcaaaatggacctcaagggttcggatcgcttcggcatccgtgaagaacacattcacttcaaagttgagctgaaagctgcgcatatccatattcgcggtgccgacggaggcgagatcgccatcaatgatcatgactttttgatgcatgaagcctttttggtaggagtacacttcaatgccctcaaggagcagctccgggaaataggacctcgacgcgtattgggtcaaaaagctgtcgttcttctccggcaccataacccttacctctaccccctttgtcgccgctgcttttagcgccgtgcgaatggattcattggggacaaaatagggcgtggcgatccatattgatttctgcgctgaagaaatcatttcataataaaggtcgctcatgctttctttcatgtcagggcctgtcgcgacaatttgataaatgcctcctccttccacgggaaccggggtattgtactcctcttgatcaattagcacttcattggagacgtattcccaatccagcataaagatagcgtggagcgtttgcacaatttccccctcaagccgcaggtgtgtatctctccaaaatccgatgtgcggatctctgctgatatattccttcccaacatttaatccgcccacaaaaccggttttcccatcgatgatcacgattttccggtgatttctgaaattcagcttctggttgaaaaacccgtatttcagcggagaaaacgggacgatgtccacccccgcttgtttcattctcataatatctcttcttgccagcttcatgcttcctgccgcatcgtataaaaacctcacctcgacaccctggcgcgctttctccatcataatatccatcatgccgcgtccgagcatgtcagatttaaacatatagtattcaatatgtatgtaagattccgcttttctcattgctttgaaaatgtccgggaaggtttcttcgccgtttttcagcactttgatgttgcttttcgtattgatattcatatgggcagccctgatggaatatgtaaagaacctctcttgattgtccttcagccctgtcacttcgggcgtttccttcttgtcaaacagcttcctgagcttttccctgttgtacattcgttttgtcttaaacagctttccctttacataaagctgtcccgaaaacagataaaacacgtagccgacgattggaaaaaagacaagaatatggatccatagcagcgtgtgctgcgaggtgcggttttcaagaattaatgaatagatgctgaacaaaataatgcttatatagcaaagcaatcctccgtaaaactcaagcctggaaaccggaaaaaaccaaatgacatatgccccgatgagcatcatatataaaaagaaaaattccagtctccttttcagcatcctgattctctccaatctgattcaattacctctgtattacctcttttttctaatcgataaaccttgtaagtaaataacctctccgccgaaggaggagaggtttagaaaaactaactgtcacggaattcatccgcatcgtttctgcagaaataaagcaagactattggcaacgccgagtgaagtctgatgatacaacatgagcggcaggccgaacccgctcagcactccggcaagcgccgaaaaagaggcggcgctgtgactgcaaatacggtggatagagtgaatttgatgcccactctgatgagagaaaatatataaaacgggatattgatcagaaagatataaggagttagtcaggctgagtcataatctgctgttccgccggtttaaaatgagtaaaatccgttttattcttgatcttatttccaaatacaaacacaacaggattcccggccgcccagccattacctttgcagaaaaaaccccctcctgggggggattttcatgagcgtttccgatatacaacgtagctgcgggtcagatacttgagcggcagactgaacacatgaaccaatcttgtaaacggccacaggataaaaacgacgtatcctatcacaatatgaaacttaaaccatagcgggacactctccatcaaagaggcgtcaggccggaacaaaacgatttccctgaaccagggcccgactgtggtccggtaatcaaatcctttcgaatcaatgttgagaaacgtggccgcaacgcccgacagcatcatgaacagcagcaggagcagcgtaaggatatcggatggcgagctcgttttgcggattcttttgtcaaacagccttctgtacgtcaggatgacaagtccggtacatgccgcaatgcccgccggcaagccagcgccaatcgccattttgtgatacatatgctctgaaatgccaagggaagcatacacgccttccgggatcagaatccccatgacatgcccgccgacaacgcacagcagtccccagtgaaaaagtgtgctgcccgccgcaagttttttcttttctaacatctcgcttgatttcgccgtccagccaaattggtcatgctggtagcggtaaatatggccgccgataaagattgtcaatacaatgtatggcataataccccagaggatctgcccgctcatgcctgaacagccccttcaacgctttcacgtacgccaatgttttcaagcgcggccagcagcacgtgcagcagttcagcgtatatactgtcatttttttcgagacgggatgccagctccctcacattggacagatatttctcaaacacgcttctcgctgcttcaatttctgcagccgcagcaaattccagcatcagcggcagataatcaggcagctctttctctgtcggcaggaaaccggattgctcgtatgtgttttttaaatgcagcaattcaacgccgcgttccctttgctcgcccgagttaaagtaggtgacatacatatttgtttttttcccaaagtcgaacgtatagacatagtgttcaatcagcgcttccggtgaaaagctggctgacgcctcgaaaaagtgcagcagcttctcccggatttgccggttgctgatttcatggataagagccttccaatcgggaatctcggctctccactcttcatccggataagagagaagagaggaaagagcggagaacgtcatttgccggtctgtggtgttcatcttgttacacctcatttatcaaaagttagaaacaggagccggggccgcctgaaaatgataagccgcagctcccttgttcagcatataaatctgaaacttcttctcgatgactgctcggtatcacaaagcggtcatcatatttggcaatcgcaagcagccgatacatatcttcaatttgctgttctgttaagccgacactggagatcagttccggatcgattgatttattcgtctggatcgctctcatatactggcgcatgacagacattttctttaacgttgaccgaatatgatccgtatcaccggctgttaacagctgcgccaaatagtctatcgggattctcatttggtcgatagccggaaaaatatcttccgcggattgccggctgccttttccttcaaagagattcataatcgggctgagcggcggaatgtaccacaccatgggcagcgtgcggtactctggatgaagcggcagcgcaatcttccagtcaatgatcattttatagatcggcgattgctgcgcagcctctatccattcagccggaatgccttgttcttttgccagcttggcaacctcaggatcatttggatcaagaaaaacgtccaattgggaatggtagagatccttttcattttcaacagatgccgcttcctccactttgtccgcgtcatacagcatgacgccgaggtagcggattctgccaacacacgtctcagagcagatggttggcagtcccgcctccaaacgcggaaagcagagtgtgcatttttccgctttgttcgtttgccagttaaaatagacttttttataaggacaggatgagacgcaatatctccatgaacggcatgcgttttgatccacaagcacaatgccgtcctcctcgcgtttgtacatggcgccggatggacaggatgagacgcacgccgggttgatgcagtgctcgcaaatacggggcaaatacatcataaagacctcatcgaattctgttttgatcgattcctccatcttttgtacgttgggatcttcaagtcccgttatgtggccgcccgcgagatcatcctcccagttcggtccccattcgatattcataaaatcccccgttaaggacgatttcgggcgtgctaccggctggtgttttttctgcgggctgttcgttaatgtttcataatcatagttccagggctcatagtaatcatcaatcgacggctgattcggattatagaaaaggcctgcaagccgattggttttcgagcccgatttcagctcgagctttccttttttcaatgtccagccgcctttatatttgtcctggtcctcccattgcttcgggtagccgatgcccggctttgtttctacattattgaagtacatatattccgcaccggaacggtttgtccacgtgtttttgcaggtgacgctgcacgtgtggcagccgatgcatttatccaagttcatgaccataccgatttgcgctttaatcttcaagccaatcgacctccttcagcttgcggatgacgacgttcaggtcgcgctgattccccgttggaccgtaataattaaagccgtagctgagctgggcgtagccaccgatcatctgtgtcggcttgacgtgaatccttgtcgggctgttatgggtgcctccgcggttattcgtcagctttgtgccgggcacgttgatgtggcggtcctgggcatggtgcataaacgccattcctttaggaatccgatgagacaaaacggctctcgcgacaacaacaccgtttcggttaaagcattcaatccaatcgttgtctttgatatccgtgtcctctgcatcatctttattcatccacacggttggcccaccgcggaacagcgtcagcattggcagagaatcaaaatacatgctgtggacagaccatttattatgcggcgtcaaataattgaggacgatttcttttccctcttgatcaggccgcttgctcagaaacgggcgatgctggaggatcggtttgaatgtcgccatcgtttcaccgaattccatcatcagttcatgatcgacataataggattgtctgcctgtcagcgtccgccacgggattaatttttcaacattcgtcgtaaacggcgaatacctgcgccctcctttttcagagccggaaaacgctggagacgtgatcaccgttttcggctgggctgtaatttgttcgaacgtaaagcactcttcctcgcgttcttccgccaggtctttcagcttcaggttcgtgatgttttcaagtgattcccatgctttgacggcgacctttccattcgaagtggatgatagggttaaaaccgcttctgccgcctgctttgcttcacttatatttggacatccctttgccacgctgtctgaggtgatttctcccagtctctttttgagtgattcatattcatcggctattgaccagctcatcccttttgttccgctcggctttaaagcagcgttaggaccgagtgcggtcattttatgaaaaatgtgtttgtaatcccgttcaacgacttggatgttcggcatcgtttttcccggaatggcttcacattcgcccttgctccagtcattgattttgccgaatggctgggccaattcctgcatggtgtcgtggaggagcggcgtcgcaaccacttctttcaccggctccatattgacttcttctgccagatcggaaacggcttttgacagcgccttgaaaatatcccagtctgacttcgattcccacggagctgagatcgccggagcaaatggatgaatgaacggatgcatatctgtgctgctgagatcgtgtttttcataccatgtcgccgccggcagcacgatatcggaatacagcgccgtacccgccattcgaaaatcaagattgattaataagtcgagctttccttccggcgcctgctcccgccatttgatttcttctgggcggatgctgtcgctgtcgtcattcattaaaccgttcgttgtccccagcaaatgcttgagaaaatattcatgcccttttcctgagcttgagatcagatttgcccgccatacaaagagattccttgggaaattcacttcattgtcaggatcttcaatcgcgaatttcagttttttctcttggagctgtgaggccacgtacgcacctacgtcttcaggtgttgctgcccctgctttttcagcttctttatacagatcgatgccattttgattgaaagtcgggtaagacggaagccaccctagccgcgccgccagcacattgtaatcagcgtggtgcttgtagcgggatgacgcagcaatcggtgatgccaaatcactgatcggctggtcctcataacgccactgatctgtcgcaaagtagaaaaatgaagtgccgttttgcagcttgggcacgccctcccagtcctttgcagttgcaatcgtctgccatccttcagcaggtcggagcttttcctgcccgacgtaatgggcccagcctccgccatttacgccttgggcgcctacaagcaaaacaagatttaacactgctcggtagatcgtgtcggagttgaaccagtggttaatgccggctcctacgataatcatagaccggccgtctgtatcgatcgcattttgagcaaactctctggcaatcttaacgacagcttcttttttgattcctgtcatttgttcctgccaggcaggcgtaaacggctcaggatcatcataggagacagcttgttgttcgccgatgccccgatttacgccgtagttagccagtatcaagtcaaacacggtcgtgacgtacgtctcttcaccgttcaggttcatttttttaataggaagatcccgctcgagcactttgtttccgtcatttgaaaaatacgggatgcgcaccgtgccgatttcatcctctattccgagcacagagagacggggttcaatcggttccccggtttcttcatcaatcatgtgcaggttccatttctgctgcccgtcccagcgcgagcccattgtcccttggggtatggcaaatgaacttgtctgttcatcccaaaccgcaggcttccactgatcatgctttgtcttccgcccgatgtccttcgcatgcagaaaccgtcccgctgtgtatacgccattttcttttgacagagtgacgagaaatggaaaatcagtgtattgcttcgcgtactcaataaaacgttcagtttcttggttcacgtaaaattcctgcagaataacgtgacccatcgccatcgcaagcgccccgtcagtcccttggcgaatactcagccagtcatccgcgaactttgaggattccgcaaaatctggactgatcgaaatgaccttagcgcctttatagcgggcctccgccaaaaaatgcgcgtcaggcgttctcgttaacggaacgttggagccccatgtgataatatagccggaattgtaccaatcactgctttccggaacgtccgtctggtcaccccaaatttgcggggatgctggaggaagatccgcataccagtcataaaaactgagcatagggcctccgattaacgacataaaccgggagcctgatgcgtggctgatcatggacatggccggaatcggagaaaaaccgacgtttcggtcaggcccgtatttcatcactgtatacagcagagaggctgaaatcagcttcagcacctccggccattcagcgcgcacaaaaccgcctttccctctcgcctgtttataggacttcgctttttcagggttttcgacgatcgatttccaggcttccaatggattttgatgcgtctgcaatgcctcccgccacaaattgatcagcacaccgcgcacgtatggatatttcacacggagcgggctgtagatataccatgaaaaactggcccccgcgggcagcctctcggttcaaaatcaggcatatccgggcctgttgatggataattcaaattttgcccttcccacgtgacaattccgtttttcacataaatattccagctgcaagaccctgtacagttgacgccgtgggtggagcgaacgactttgtcgtactgccatctgtttctgtatacattctcccaatcgcgatcctcgcgggtagtttggctatgtttatttgaatggtgttcgataggagagaaataattcaatctcctaaacaacggactcattttctttttcttcatgagagttcactccttccgagtcaggtgatgctaagttcactataaacagagacagcgtgttttcttgtgaactatgtcacacactctgcttttttcacaaaatgttcacacaaaggagaaggaaggctgagttcaggcaggacgcttgggtcattagctgcctttcattcaaagatcaaaaaaaaccggctctatttaagaaccgggctcggcgttttcatcctgtgatgtatgcagataccgcaaaaataattgataggaacaaaaaacattttgctgaagcatagccaaaaagttcatttgcagctgcggatgataagacatcattttcttaaatatgtaatatgggatgttgagaatcagaatgtctgaagtggcattgactgagataaagggcgataaataaagcccgcctttttcatcaatcggaaacacatcgcctttttcccacagcgcaacggttttcgacccttcagggagccttgtgtccataaaacggacactgccttttaatacaatataaacagattgagaatgaagaaaagatggagactgatcacatgaaccgcggataaacgtgccgtttttcagcaaggtttcgacaatggatagaggcacttcattaaacataggaagttgtttcagaaataataaatagtcacactgattcataggaaaacctcctgtgctaagctaaggatagctttagtgtagctcgactgagcctgtacagcagtgatgtatttcacagcctgtatgatgaatgtcacttatcaggagggtgaatgcatttataatgaaagaaaaaaggaggatttcgatgaaggcgctgattccgaagcagcacggggcgtgggcgatgctgctgatcccatttttactcggcatggtcaagggaggccccgttatttggcatattccgctcttcctaggctggcttttcctatacttagcggtttatcccgttacgcttgccttaaaaaagaaccaaagcaaaccttatcaaaagtggatgtgttattacggttttcccgcctgctgctttttgatgatctcggtctttcataagccgcctctcatctgggtgggcgtttctttactgccgctgtttctcatacatatgtattttgcccgcagaaaaaaagaacgagccctattgaatgatgttgcaggtgtcttgttcttttgttcgggcgggtttgcgagctgctggctggggatgggaaccctcgacggctgggcttggtttattttcttgcagtctgctttattttttatcgggagttccttttatgtgaaatcggtgattcgtgaaagaaaaaacaggacatttgcatactggtcatggggatatcacctgctgctcccctttttatccgctcttttcggagcaggatgggcgtttctcgcttttatcccgagcagcttgcgggcatggttttttcatggaagggattggcccgtaaaaacgattggcattctggaaatcgtgaatgcctgtttctttcttgccgtcatgtgcctgtttatcacaaggtaaaaaaacaaggacaccgctgtccttgttttttcagtcaatattgcaaatctccagcgggcaattttcacactcaatctcacatcgtaaatagtcccgcttgtgcaaaataatttttccggattcgtctatcgaaataaccccttttttgcggagatctcccagcatacggttgatgctttcccgtgcagccgcacaaaactttgccaaatcctgatttgtcaggacaatgttaatcagaatgccgtcgcttcgctccactccgtagctgtttgataagcggataagggtagaatagagcgccccctttttgccatgaagaagcagatccctgattttggactgaatcttccggaggtgcgtgctcatccatttcatgaactcaaatgtcaaagcgccgttttggattaattctttttccagcttatttttattaatgacgagcacctcgccatcctctagtacttttgcactgagcatataccttggttcttcagtgaaaagtgttaattctccgacgatatcatgcttttggcagattctaagcgtcaggtcttttccgtcagatgtcagcttgccgatttcaatgagtcctgattgaatcagataaagctcttctgcatccattccttcccgaaacaaatacgtgtgtttttccatttttcttttcgtgctgatcgattccagcaattcatacagatcgctggatatatgatcactatcagatggtcgaacagagagaaaattcatgagctcacctcgaagaaagtcacgttgtgtgtttattgtaacgtgaattgatttgtacccatcgagaaaaaactaacaatcttgtgaatgccccagtgttagttgatgctctggctgtttctctccgtgtgtgttttcattctttcctgccaatacatccatatgacaaggacaaaactggctaacgccacctctgaaagcgccataaacccgatcgcgtactggcctgttgcctgaaatacactcgccaatatgagcggaggaaaaaagccgcctaaaccgcccatggcagacacaatcccattggcaatccccgcttgcttcgaaaaatagaaaggaaccagtttaaaaacagtcccatttcctacgcctgagcagacggccacggttaatgatccaaacgtataaaggccgattgtcggcgagaacgataggataatgcctgataatgtaagcccggcaaaaacaaacatcaagatgcggagcgggctcattttatcagccaggaatcctcccgcaggcctgagcagcgtagaaaccgcaataaagccagccgtccgcaagccggcatctgcaggattcagcccaaaatgctccaccagaaagttcggcagatagatagtgaaggcgacaaaggcaccgaacgtaataaaataaaacaggctcagaaaccatagcacatgatttcggtaaacagctttgatttgagtcttaacagaaactttgaccttcttctcatgcctgtcgccaaacaatacgtgcagtaaggcaaagacagacagcaaaatcagatacatttgcacggttgatttccacccgacggcttgagcgataaccggcgctgcaaatgtcgtaacggctgtcccgatatttcctgcaccgtaaatcccattgacgacaccgtgcttttctttcggataatatttcgggagggaggtcaccccaatggaaaacaccgctcccccgatccctaagaaaaagccgcctgcgattaaatcaaacagagaatccgcgatactgatccaaaatacaggaaataaaagcaggatgaaactgaccataaacatgagccgcgcgccaaacctgttcgttaaataccctaaaggaatgcggagaagcgacccgaggatcacaggaatcgccgtcaccaaagaaatctcacccttgcttaaatgaatatctaatgtgatttgggaaatgagtgatgaaatcagcacccaaaccataaaccctgccaccaagcttaatgactgtaacgataattgaatgtgttgacggttgatcatttggcttgcccctttcaatgattcaataatcagtcttatcatacaaaaactcggcaaacaggattgtgaattacatcacacgtttttctcataaaaaaaggacaaagcccgaagactttgtccttttgatcgtgattacattttttccggagccgatacgccgatcagctgaagcgcattgttcagcgtaatttgcgttgccttcattaaagccaggcgcgcgcggctcttctcttcattttcagggtcgatgactttctctgcgttgtagaagctgtgcagagcagaagccagatcataaatatagtttgtgacacggtgcggaattcgtttttccgctgcttccgccactgcctctgggaagccgccgatcgttttcagcagatcgtattctttttctgattgaatatggctgaaatcaagatctgccgccggtttaagtccctgctcttccccttggcgaagcatgctgcaaatacgggcatgcgcgtattgtgcataatacacagggttttcgttagatgttgatacagcaagatctaagtcaaaatccatatgggtgtccgcacttcgcatcgcaaagaagtaacgaacggcatccaagccgacttcttctatcaggtcacgcatcgttacggctttaccggtccgtttgctcattttcattttctcgccgtttttgtaaaggtgaacgagctgaatgatttctacttcaagcgttcctttttcatagcccagcgcttcaattgccgctttcatacgcgggatgtagccgtggtgatcggcgccccaaacgttgatcagcttatcaaagccgcggtcaagcttgtccttatgatacgcgatatcaggaagcaggtacgtgtacgtgccgtccttcttgatcaatacgcggtctttatcatcgccgaacgtcgtggaacggaaccaagtcgcgccgtcttcttcatagacatggcctttttcgcggagcgcttcaagcgccgtgtcgatttttccattttggtacagtgaagtttcggaataccacacatcaaacggcacacggaagttttccaagtccttgcgaagcttgtccagctcgtatttcaggccgtattcacggaaaaacgcgaggcgttcactttcctcttcgttaacgaaacggtcaccgtattcctcagcgagacgctttccgatcgcaatgatatcctcgccgcggtagccatcctccggcatcggtttttccaatccgagcgcttcaaagtaacggacttcaacagaaagcgccagattgttgatttggtttcccgcatcgttaatgtagtattcgcggcttacatcgtaacccgcttttgaaagcacgttgcacaaggaatcgccgacagccgcccctcgcgcatgcccgaggtgaaggtctcccgtcggattcgctgatacgaattctacctgaactcgttcaccgtttccgatgttcgtttccccgtatgcttcccctgcttccagtacagacggaatcagctttgttaaatattgattgttcatatagaaattgataaaacccgggccggcgatatccagtttttcaatcgaagcctttcctttatcaaaatgggcgacaatctcttcagcgatttggcgcggcgctttttttgccactcttgccagctgcatcgccatattcgttgagtagtcgccgtgtgttttatctttcggtgtttctaaaacaacattgggaatctggctttcttcagccagtcccgctttcagaacggccgctttaatttcttctttcagcacgtccttcatttgttccgcaatgttcatgcgtgagttcctccctcatacgtgatcgtcatattatgtaaatgctcctgctcgtctccgacatgcatgtcatatgcgatgctgatacggcctttttcttcatcgagatcagattgaatcgattttgtgcttgttttcagctcaagctcaccaaatgacattttatatttagcaattgtggaagctcccgttacgaaacgctgattcattttgacagcgcctgacctcatgaccaggacttcgccttcgcttactttcacaatcgttttgactttgcctaagtcgtgttcttcataataagatagatacactttattttgttttacatagtaaaatccggtggtgcggaattcgatgacttcttggtttccgtcatcctcgatcacagacttcacatggagtgttatcggtgtctcttgcttcattctgacacgtccttttcatcattccactttgacttgaatagtataatcattcggtttgtaaacttcaactgcttctatcttaccatcattgctcatcagatttgaagataaacctcataaaaagcatttccttatatagaagagaaaatcatatcactaattacctttaggaaatgttacatttttccgaaatctatcatttccttttcacatttttttcaaaatatatgtattgaattagtaatttgatagttttaagataaaagtacaacatagatctgctagaaaaacaaaaaaagggaggattcaattatgaaaaaagctgtcattgtagaaaacaaaggttgtgcaacatgctcgatcggagccgcttgtctagtggacggtcctatccctgattttgaaattgccggtgcaacaggtctattcggtctatgggggtaaggatctcccaaaagggcatagtcattctactatgccctttttaagtaaattacaatttttaactaaaatctacctcttggatatacatacacaaccgtttttcatttgaatcatatgtataggggatggtattttgtttatagagcagatgtttccatttattaatgaaagtgtaagggttcaccagcttcctgagggtggcgtgttagaaatcgactacttgcgcgataatgtctccatttctgactttgagtatttggatctcaacaaaacggcttacgagctttgcatgcgcatggatggccaaaaaacagctgagcagattttagctgagcaatgtgcagtgtatgatgaatcaccggaagaccataaagattggtattacgacatgctcaacatgctccagaacaagcaggttattcagcttggaaaccgggccagccgccatacaatcaccacgagcggaagcaatgaatttccgatgcccctgcacgccacctttgaactgacgcaccgctgtaatttgaaatgcgcccactgttatttggaaagctcacctgaagcgctcggcaccgtgtcgattgagcaattcaaaaaaacggctgatatgctgtttgataacggtgtattgacatgcgaaatcacaggcggagaaatttttgtccatccaaacgccaatgagattcttgactatgtgtgtaaaaagttcaaaaaagtcgctgtcttaacaaacggaacactcatgcgaaaagagagtttggagcttttgaaggcttacaagcaaaaaatcatcgtcggcatttctcttgatagtgtcaattccgaggtccatgactcctttagagggagaaaaggctcttttgcccaaacttgtaaaacgataaaattgttgagtgaccacggtatatttgtcagagtcgccatgtctgtcttcgaaaaaaacatgtgggaaatccacgatatggcccaaaaggttcgggatctcggggcgaaggcgttctcttacaattgggttgacgatttcggaagaggcagggatattgtccatccaacgaaagacgccgagcagcaccgcaagtttatggaatacgagcaaaatgtgattgatgagtttaaagatctgattccgattattccttatgagagaaaacgcgcggcaaattgcggcgctggctggaagtccattgtgatcagcccgttcggcgaagtacgtccttgcgccctctttccaaaggaattttcattgggaaatatttttcatgattcctatgaaagcatctttaactcccctctcgtccataaactgtggcaagcgcaggcgccgcgcttcagtgaacattgcatgaaagacaaatgcccgttcagcggctattgcggaggctgttacttaaaagggctgaactctaacaaatatcaccgaaaaaacatttgctcttgggcgaaaaatgaacaattagaagacgtggtccagcttatttaggagggaaacgatttgtcaccagcacaaagaagaattttactgtatatcctttcatttatctttgtcatcggcgcagtcgtctattttgtcaaaagcgattatctgtttacgctgattttcattgccattgccattctgttcgggatgcgcgcgcggaaggctgactcgcgatgagcattttggatatacacgatgtatccgtttggtatgaacgggacaacgtcatcttagaacaagtagatttacatttagaaaaaggcgccgtttacgggttgcttggggtaaacggcgccggaaaaacgacactgattaatacgctgacaggcgtgaaccgcaatttcagcgggcgctttacactgtgcggaattgaagcggaggccggcatgccgcagaaaacatcagatcagctgaagactcaccgttacttcgccgccgattatccgctgctatttacagaaattacggcgaaggactatgtgtctttcgtccattcgctttatcaaaaggatttttcagagcagcagtttgccagtttggccgaggcctttcatttttcgaaatacatcaacaggagaatttcggagctgtccttggggaacaggcaaaaggttgtattgatgacaggcttattgctgcgcgctcccctatttattttggatgagccgctcgtcggtttggatgtggaatcgatagaggtcttttatcagaaaatgcgcgagtactgtgaagcaggcgggaccattttgttttcttctcatctgctcgatgtcgtgcaaagattttgtgattacgcggctattcttgacaacaaacagatccaaaaggtcattccgattggagaggagaccgatctgcggcgggaatttttcgaggtgatcggccatgaataacataatccccatcatgtctttgctgttcaaacagctttacagccggcaagggaaaaaggacgccatccgcattgccgcaggccttgtcattctggccgtgtttgaaatcgggctgattcgccaggccggcattgatgaatcggtgttgcgcaaaacgtatatcatactcgcgcttctcttaatgaacgcatatatggtgtttctttctgtgacatctcaatggaaggaatcttatatgaaactgagctgcctgctgccgatttcttcacggagcttttggctcgcccagagtgtcgttttgtttgtcgatacctgtttgagaagaactttattcttttttattttaccgctgttcttatttggaaacggaacgctgtcaggggcgcaaacattgttttggctcggcaggttttcgttttttaccgtttactccattattttcggagttgtgctaagcaaccacttcgtcaaaaagaagaacttgatgtttctgctgcatgcggcgatattcgcctgtgtatgtatcagcgccgctttgatgccggccgccacgcttccgctttgcgcggtgcatatgctgtgggcggtgatcattgactttcctgtctttctgcaggcgcctccgcagcagagcaagatgcattcatttatgcggcgatctgaattttcgttttacaaaagagaatggaaccgatttatctcttctaaagcgatgctgttaaattacgcggtaatggcggcgttcagcggcttcttttcgttccagatgatgaataccggcatcttcaatcagcaagtggtttatatcgtgatttccgcgcttttgctcatctgctcgccgatcgcccttttgtattcgattgaaaaaaatgaccggatgctgcttatcacgcttccgatcaagcggaaaacgatgttttgggcgaaatatcgcttttattcaggcctattggcaggcggatttctccttgtcgtgatgattgtgggtttcatcagcggccgtccgatttcagttctcacttttttgcagtgcattgagttgctgctggcgggagcttttatcaggttaactgcggatgaaaaaaggccctccttcagctggcagacggagcagcagctatggagcggtttctcaaaatatcggtcttatctgttttgtcttcccctattcttagccacattagccggcaccgctgtatccttggcggtcattccgatagccggtctggtcatagtctattacctgcaaaaacaggatggtggtttctttgatacaagcaaaagagaacggcttggaagttaacctgctgaagactcatcaattttcaactatttcaatcgccgcgagctttctgaaaccgatcgaaagcgcggcggaacctgaggaagaaacgatttatttttacggcgccgccgcatacctgaaggagcaaattattgacgctttcggttgtgctgccggcagccgtttcatgtactcagcgaatctcttttttgatcagcagctgaaaacctgcgggacccgtttgattcacccattatataacgggaatcttcatgttgacgccctgctgaaaacttttgcagacttgtctttcccttcttctctttcattcgaagcagttgaaaaggccaggaatgagctgctgctgagaatcgaaaagaaattcactgatcctttctcctactcggcggcgcgcttggctgaggaggtcttcggaaacccgatgtacggcacaggcatgtttggccggaaagacaggataaaggcgattcatcctaaacggtttctcgacgcaacggactttatcgttgatttagtgtcccagcaaaaacagctgaacatattgggacaagtacaagcatgtgatgttcggggacatgccccgcaaacgtccgctgtaacgtccgaaagaatacccgtaaaccggcatgtttttgaaacagagacacgcagcgctgcaggtccttccgtcttgacactcggatttgactgcggagagatgaaagatgccagcgattatatcaaaatacagctaatagacggattactgggaaagtacggccattccgctttattcaagcacttcagagagaaggatctggcagtctatcacgttatcacccgttacgatgtcatgaacaatttgctgcttgtttcaatatgtacagatcagcttcatgagatagacattcccccgcgcgttttggaagctgtctcagcttttcatacagatgagcgggaactagaacaggcaaagcagtttttacgcaatgaattgctgctgcaattcgattctcccgaaggtctattggcctatatggggatcctgcgccgcttctcctgcacgaaagaagccttgctggatggcatctcagcggttacatgccgtgatgtattgcaattcatagcgaccatcaattatatcggagctcatgtagtaaggggatgaagagatggaaaagaaagccttttttcaacaactggatgaacgaaccgatatcagatacacagacagcggactaaaaatattcagattgaaattcccccgcgcccacctgcggctgtgcaatgtaaaaatcgattttggaagccgggatgtatgtatacgggcagaatccggtgatacactgcttccgtatggcacagcgcattttttagagcatcttctcttctggcataacggccgcaatctgtacagtgatttttttgcgcatggcgcgcttttaaacgcattcactacctacaccgataccaatttcatgtttacctcattaccggatcggctcagacaaacgatccccatcctgcttgatgctttatggaaccactcatttgacaagaagattgtcgctcaggaaaaagctgtgattacaagcgaaattcaaacagcacaccttaaccatcagctctcatatcattatcagctgatcagcatgctttctccctcctcaccagctgccgttttccccgcaggcagaatcgaagatattgaggcgctggacatcagtgatttacaaaaagcctataaggctgcctaccaagcccatcggatgacgctgtttttgattgggggctcagaaaatacagaaacgcttttgcctcctcacctccagctggaaaaacgtccggattatcatgctgaaagaaaaatcatcccggcatgccctccagccctctcacaaaaaatggtgctgggtgatgaggagcggatggaagatacatggaccggattacagatcggcgcacttcccgggcaaaacgatctgttggcgataaagctttattgggatatcgcggctcgtattctatttcaattagattcaccgttttttcaagagattcagcaaacgtaccgtctggaaatcgatcgcttgtcagccgagacttatatatatgaggatggcggtttcttgatccttcacagtcaagggacccattcttcagcttatatcgatgtggcttcatactatgtcacacagaagaaagaacaggttgccgcctggcttcaatacggcaaggactctttgacagacgcgatcatttatgacagcgattatgtgcgtaaatgcttcgagtgggcagccgagtgtgacaggtgcgattgctcgtttcttgacatgtaccacatcattcaagatatggatgcgcaggttttcttgtctctcattgatgcaatggcatcttctaacaaagcgatcattcacgtttctcagaaagaggcgatcagacaatgaaaaaaagcactgtctttacccttttattgctgcttataggtatggcggcttattccttcggatgggttcaggccgttgccgaagccgccgcccaatatgtacagatgatcaacaatgatgctgttcggctcggactgctggcttgtaccgctgccctcctgatgctgcctgcttttctatatcttcattatgtcacccaatccgtgaaaaacatgacagcagcttttcagaaactcacacagtctcatcaaagctgctgtgactttcagcaacacaacttgtgcagccgatatgcagaagacgtcaaatcgctgcgtgacagctataaaaacgtccgccaaacatacgtgatggctgccgtgttgtgccaagtcatcatattcggctgcatgttcgaaatcgttaaagccgtccctttccgccttcacacgccccctgccctttcaatgggacttgcgatgctactgattctgtatttattgttttgcatgcgaacttatttgcggcagcttttccggcacggcagcctgttcagaaaagtgtttgcgggagcgctggcagcagccgggatttggtggatactcagtttctctataagtgaactgctgtttctgattatcctggctaccattcagcaaatcggatcatttatttataaacgattctcttatcgcagcaccgcttctcttgatctataaaatagctacatcgcaatcgcagacggacccgcgccaaccggaatcaccgtcacggctgtataatcacttgtgcggtacacggtcacagcattgtcgttgggctgtgccgcataaatatactgtttgtccggcgttacggcgaggtcaaaagcgccggggagagacacgtttgcaatgatcctctgtctggccgtattaactacatataagttattaataagaaacggttcactatatggctctagaaaataagctctagtgctatcgagagaaaatacaatcgtcctcagcgtttcaaataaacggctgaagtcccctcccctgcttaatggagacaaactaatctccgttacacctttcggccacagctcaccattcaacacgtacgcaaaatttccagcgtaaggagttgcaattaaactgggaaattcaaatgtatctatgatactttctaccaactgcccagtatttatatcatatttatcaaccgaccaactgcttccattagcggtatagacatactgtccattcggatcaagagcaaagtctaaagcgccgggtatcggaatgacatcaatgaccgattgagaggccgtgttaatcacatatatagatccggcggccatcacgtatgcgaactcatcttttggatcaaattcgatctttctcggccctcctccaacagtaatggtatttatgatggttaatgttttattatcaatcactgagacaaggttggtatttccatggaggacatacgtgaatgctttatcgaaagtaacgcctagattagttggcacgtcagaaaaagggattgtttttacaacagtgtttaaatctgcatcaataaccgaaaccgtgctgtctccagtattggcagtaaacacatacgattgagggtctggtgatggcggtaaaacaagtgtcccggtcaccgtaagcggactgccgtagaaaggcggtacaatgagcagatcttccactgttatttgactgaaatcaggacagcggccagactgtgctgcataataaacaacttgatcaatctcttcggtatgaatcacagaaaccgccccattgccttgtccatattgatttcgcacaggcgacacactgacaagaagcgtaatggtcccttgtactctcacagcatatcgaacaccgatatcttctggttccggcccagtctggattaagcaaggctcactgatacaggacacattgtctgtactccatgtaacagccgctgacgcttcggccgaatcaaccttgaagccctcagggatatctatcggcacttgaaacggcgcttctcggctaatttcctcatcacaaaaacagaaacaattttcctgtaaagcagaaagatcattctttttcatgatttcacgtccttttagaaatgcacaacatgcagcggttaaatcgtaatggcacccggtgaaaccccaagagatatcacagtttcctcagaataatcatctgtgttgtaaacaatgatgctctgctctataaaacgagttgcatacagaaaatcgccattcggggtaaacgcatagtctgttgctgattgcggaagatttccaattacacctgctccattcggactgacagaatataaattgccagtgaagctgtcatgtaaatacacctctgatccactcgtaaacattacatatagcccgtcaggctccagctcttgggtatccctgatcgtaaacgtatttaaatcaataaccgtcaaataattgaataagaattcttgttctaatacatacgcataccgctccgtagaatctgtttctatggatgatacgataagctctcgttcaatcgttcctaagacttcaccggtagataagtccactttttgcactaacccaaaattaagaacataggcgaacaacccattggggtcaattgcaatatcaaaaccttctacaggaatagacctctcaacagtcaacgtatcaattccaatcacataaatggcagtaccggtgaaaacataagcaaactcatgattagggataaatctaatcaatcgaggcggctgatccagcaatatagttgctgtcactgttaatgtgtcataatcgatgacagaaatcacattattgttgggatgtaagacaaacacagcgcttttatctggcgtaatttcaatacctgccggattgtacggaagagcaatcgttgtcacaacagaatgagtgtttgtatcaatcacagaaactgattgatcatttggattcgctgtaaacgcataaacgggttccggctccggtacaagcacaatcgtccccgtcaccgataaaggactgccgtaaaacggcggaacaacaacaaggttctcaatcgtgatgtcactgatatccgggcaatcatccggttcatcggaataatagacgacttgatcgatttctgcattgtgaatgacggaaacagccccgtccccttgtccatattgatttcgcacaggtgagacactgacgagtagcgtaacggttccctgcaggcgcactgcaaattgaacaccgatctcatcaggctctggccccgtttgaattaagcaacggtcactgacacaagaaaggctgtctgcattccacgtcacgtttgcaacagcttcagccggatcaacgacaaatccttcaggtaattcaatcggcgcttgaaacatggcttctcggcttgcttctccctcacaaaaacataagcactcttcttgttctgctcctgctttttctttaaaggaaagcttgttttttctcattccttcacttccttttcagacatacactgctcacgcagatataacagaatatggaagtgtaacgtgtttgcttgtacaaattgctgagggtaaacgcttctttttgaaaatatatctccaaacatgcggtgtaacgaaagaaaaaattgcggtttttttgcgcttctcacaagaatgttgatgataaaatatgacatatatagaattatgaagggagggatttgcaaacgtgacaggtgtcatatcttcttcttccatcggagaaaagattaacgaatggtatatgtacatacgccgatttagcatacccgatgcagaatatttgcgacgagaaatcaagcaagagctggatcaaatggaagaagatcaagaccttcatttgtactattcactgatggagtttcggcacaacctgatgcttgagtaccttgaaccgttagaaaaaatgagaattgaggaacagccgagactgtctgatctgctgcttgagattgataaaaaacaggctcgtttaactggtctgcttgagtactattttaatttcttcagaggcatgtatgagctggatcgccgtgaatatgtattagccattcaattctttaaaaaagctgagagcaagctggtttttgtgaaagataaaatcgataaagctgaattctttttcaaaatgtcagaagtctattattatatgaaacaaacttatgtctccatggactatgcacgtcaagcattcgaaatatacagtgaacagactacatatgatatcagaatgattcaatgccagtccttattcggagccaactttttggatttaaaacaatacgaaaaagcaattgcccattttcaaaaagcctttacacttgcaaaaacagagcagaagccccaattaatgggaagaacactttataacatagcactctgcaagcaaaaccaaaacagttttgaatcagcgatagagtatgtaaaaaaatctattcaagtatttgaaggatctaaaatgctcccttcactgccacaagcttttttcctaattacacaaatttattttaaattaggtaagattgataacgcctgtgaatatcataaaaaaggaaaagagtattctgcagctgcgggagataccgtgtatctaacggagtttgaatttttggaatctttatacttgtctggaccggatgaggaacggatagaaaaatgttttgtttttcttgaaagtaaaatgatgtatgcagatattgaggacttcgcacttgatgttgctaaatattatcatcaacaggaaaattacaaaaaagcatctcattactttttaaaggttgaagaagcaagacagcacattcaagggggggtgaatttatatgaaatggaagtataaattattactcgcttgtttagctgtgagtgctgtatttatcacagtcgaagtatcaaattcatcaacagaacattttgatgttgcgcaacgcgccatgatctaaaccgccgtccatcggcggtttttttgtcccctctttacccaatctcccaattcatgctgtgatttttttcaataatcttgaagagagtggaaatgcagcatgtctctgtaaagtgtgagaacccactttacacagtggaatcgagaaaatgatgtgacggagttcgaaacgtcgagcgcgacagtgttgaacagacagctgagacgatcggcgtaagcccgactagaatcgccaagaccctgtccttcagaggggaaggagatcaggcgattctgattgtggcagccggcgatgccaagattaataacaaaaagttcaggcaaacatttggctttaaagcaagaatgctctctcctaatgaggtactggagcagacaggccatgaaattggaggtgtttgcccatttgggttggctcatgatcttgaggtttatctagatgtatcgctgaaacggttttagactgttttcctcgcatgcggcagcagaaactccgctattgaggagaattatccgaattttctttctcaaaagcatggattgatgtttgtaaagactaggaataaaaaacatccagacatcgtctggatgtttacttatttcacaaacccaagcagcatttcacggatgattttgctggctgtgtttgccgtttgctctgagtggtcatacaccggtgcgacttccactaaatcagcgccctttacgtttacctctgaacgcgcaatttcatggaccgatgcaagcagttctttagacgtgatgccgccggcgtcaaccgttcctgtacccggtgcgtgtgcagggtctaatacgtcaatgtcaattgtgacataaaccggacggcccgccagcttcggaagcacctctttcagcggttcaagcacctcaaattttgagatgtgcatgccgttttccttcgcccattcaaactcttctttcatgccggaacggattccgaatgaatacacattgtgcggtccgatcaattctgccgccttacggatcggcgtggagtgagaaagcggttctccctcataatcaacacgaagatctgtatgtgcgtcaaaatggataatcgcaaggtctgggtatttcttgtacatcgctttaatgacaggccatgacacgaggtgctccccgcccatacccattgggaacttccctttttctaaaatgctgtccacgtactcttcaatcatatccaggcttcgctgcggatttccgaacggcagcggaatgtcgccggcgtcaaagaagttcaagtcagccagatcgcggtctaaatatgggctgtattcctcaaggccgattgacacctcacggattctgcttggaccaaagcgtgagcccgggcgatagctgactgtccagtccatcggcatgccgtaaagaatggcatccgcctcttcccactcgggacggctcgcgataaatacttttcctgaataagcttcatcaaatctcatcgataataccctcgctttcctgtaaaaaagcgcaagattcgctcctgcgccataccttcattatttaatcaggtcactcacaaatttcggcagaacaaatgccgctttatgaatatcttttgtgtaatatttcgtctcaatatcgaagaaacggctgtcttccactgcaagcggatcatattttttcgagccaattgtaaatgtccacaaaccgctcggatatgtcggaatgttcgccgtatacagcttcgtaatcgggaagatttccttcacgtcgcgctgtacatttgtgattaattccggtgtaaaccatgggttgtccgtctgtgcgacaaaaatgccgtcttctttcagcgctttagcgattcctgcgtagaatccttttgtaaacaggtttacagccggtccgactggttcagtcgaatctaccatgattacgtcatattgattttcagattttgcaatgtgcataaatccgtcatctacctgcacgtcaacgcgcggatcatccagtttgcctgcgatagaaggaaggaactttttagagtattcgatcaccttgccgtcaatatctacaagtgtcgcttttttcacgcttgggtgcttcaggatttctctgataacgccgccgtcaccaccgccgactacgagaacgtgctccggatttgggtgcgtgaataatgggacatgcgccaccatttcgtgataaacgaattcgtctttttcagatgtcatcaccatgccgtctaaaaacagcatgttgccgaactcttctgtttccaccatttctaaatgctgaaactccgtttgttctgtatgtaacgttttgttaaccttcatcgtaatgccaaagtttttcgtctgcttctctgtgtaccaaagttcgctcaattgtcatctccctttcgaggctgtattcatttattgtaagcgtcttatcagcttttattctcggttgaaatctcattttcacctaaggaaaaagtatagaggatgccggggaaaaagtaaagatgcgtcctgttctgcgatgtttaaaaacgatctttttttctcataatagtagaaacataaaaaaaggggggaacccgttgtggatgcaatgacaaataaacggctgagactgacgctgaaaaccgttcgcgcctttatctttttaggggcttttgcggccttggcggcagctgccgtgtttatgactgtcattttgatagccaaataccagggcgctccctcggtgcaagtgccgcaatccacgattttgtatgcgagtgacggctcaaagctcggggaaacgaactacggcgaaaagcgctattgggtccccttaaaggacatgaatccgacgatcgtaaaagcgacagtggcgattgaagaccagaatttctacgatcatcacggctttgattataaacgcatggccggcgcggcgcttgctgacctgaaagcatttgccaaggttcagggtgcaagcaccatcacccagcaatatgcgagaaacttataccttgaacacgacaaaacgtggaaacggaaatggaatgaggcgttctacacgatccgtctggaacaaaactattctaaggacgagatattagaaggctatttaaatacgatttactacggacacggcgcctacggcattgaagcagcttcccgcctatatttcggcaagcatgccaaaaacctaaccgatgcggaggcggcgcttttggcaggtatcccgaaaggcccttccggctattcaccgtatgtcaatgagacgaaggccaaggaacgccagaaaacgattgtgcggatgatggaaaagcagcagatgatcagccaaaagaaagcggatgaattgatcaaggaacctctttcctatcagcctttgaataagcaagtttccaagagaaaggctccttatttctacgacaatgcgatgagagagctggagaaaaagctcggcatgacacgggagcaaattgaaacgagcgggttaaacgtctatacaacggtagataaacggatgcagcgcatcgccgaggagaccattaccgaaacggttaacgcgggctctgacattcaagtcgggttttcagccattgatccccgcaccggaaacgttctcgcccttgtcggcggcaggaattatcaaaaaagcccgtttgaccggacgacacaggcgaagcgccagcctgcttcgacgatcaagccgttgctgtactataaagcgattcagagtggatttacgccagtcactttaatgaaaagcgaagaaaccgagtttcaaattgatgcaaagggagaaacctattctccaagcaactataacggatactacgccaacaagccgattacgcttctgcaggcgctggcgctttccgacaatatttacgctgtgaaaacgcatctttttctcggcacgaacaaacttgtaaagacggcaaaggaattcggcattaccgcccatcttcaagcactgccgtctctggcactcggcaccgaacccgtgcgtccgattgagatggtcaacgcctatgccatgctcgcaaatggcggaaagaaaatcgaaccgacttttatttcaagggtaacggacgcagccggccacgtgctgtacgaaaacccgaatcagcataaacaggtgcttgatgaaaaagccgcttttgtcacagcgagtatgatgacaggcatgtttgataccgatttaaatggatatacgtcggttacgggacgaacgatagccaaccgcctgacaagaacgtatgccggaaaatcaggaaccaccagcgcagacagctggatgatcggcttcaatccgaagctggccgcaggtgtttggaccggctatgacaaaaacagcaccatcgactcggtcgaagaaaaaagctatgctaaaaccatttgggcggacttcatggaggacgcgctcaaaggcgaaccggaaaccgcgttcaagccgccaaaaggcgtaaccggtgtgtacattgatccggaaacaggctactcatcaggtcccggctgtgccgctaagcattacacatattttgtgaaagggacagaacccgcaaacgtgtgctacggggcagaacccgcaaaacaaacaaaagaccggcttccatccaaagaaaagcccgcttccgagaaaaagtggtgggacaaatggctggggcgacatcattgaaaataacccggctcctcggaggccgggttattcgtatggttccttcataatcgatggaagaatgttagacaatcgagctgaacaatcagttttgggataaagtggtgaatttctcatttcttcggcgctggctttcatctcccagtcgccgactcatatccccctaaaaatgaaaaaccccgagtcttgtttcggctcgggattttccatgtcctatttctgtatcaccagtttactcaatgtttacgaaaaatatctcaaatactttaaaagttcacagaaaattcataaattaattgttttccggaagcaggcttgtttttaattcatctgatgaacggtcccataggccctgatcatgctttttcagaaattcgcctagtacacgcttcgagctgtcgtccattttatcaacgatgattttccgtttcatggatttatccatcaaattcacatgctcaggcagcgacttgtagcctcttctgatgcttctgtcgaccgtcatttcacaggctgtcacaccagcgtaataaggcccctcttcttttctgtcaatcgttacccacacaagccagtatggttttccgttcggcacttcttctttattcgggagaaatttaattcctttttcaacggtgctgcgggcatgcatggcgccgatgtctacgaacgcttctttttcttctacatcaacgaatacgggagaaatgttatcaaggctgagtgcccctacgccaaaaccgccgtgtccgtctgtcggatcacttttgataatattaaacccgattgattttttctttttttcttccatgaagttctacctcctacaaaagcggttgaaatatcgctgaaaacagctttaaaatcgaatctcttcctgcattgagcatcggccacagcacgtaagatcctagcggtgtcacaaacagcaccaaaaatacgataaagccgtagctctccgcctgcgtcattttggtacgcatgcccggcggaacgagatcttctataattcgatagccatcgagcggaggaagcggcagcagattaaataaaaacaagacaagattcagctgtatccaaatggaaaaaaactgatccagccccgtgctgaacgccgcaagcatttccattccgtacgcatgcatcaacactaacaaaaagaaaccgataaacgcaagaatcaggttactgacgggcccggctatagatacgagcacaccggcaagccggggtttcttaaagaagcggcgattcacgggaatggggcgcgcccacccgaagccggccaccaaaatcaaaatggttccgaacggatcaaggtgtttaatgggattcagcgtcagtcttccttgttttttcgccgtatcgtcaccgaatttgtatgcgacataagcgtgggcaagctcgtgcatcgtaaacgacacaattagcgtgatgacgaggtatggcattaaagataacggataatataaaaaacggtccaagtgagatatccctctttctcaaaatgcaagaatttactttattcagtatactataagaagcctctttttctaaagagaggaaacgagataaaggaggattcagcacccatgccatacgtaactgtcaaaatgctcgaaggccgtacagacgagcaaaaacgcaatcttgtcgagaaagtaacagaagccgtaaaggaaacaaccggtgcttctgaagaaaaaattgttgtctttatagaagaaatgagaaaagaccattatgccgtcgcaggcaaacgcctgagcgatatggaataatctctataaagccggcgcttcgcgcaccggcttttattatccctattgagccagcttcgcaataatcgccaagaacgtctttttctcttcggctgttaaacgttcaaacatgccatcaatcagctgctggcggttttcgatcatttgttcagccgctccccggcccgcttcagaaagcgtaatccatacagtgcggcggtcattgttatttctcgatctctcaataaacccttcctgctctaaatgattcagagctgtggtcgtggcagagggagacagtgtgacctccttcaaaatatcctttatggtgcagctcccatgtctgtatatgatccgcagaataaatcctcttacattattcacgtgtttcggaacggtggcttcatctaattgcttcgtgcttttcaaatattttgtaagtgcgtgatccagcaaatttgcttccagtttgtcatggtccatgtcaatttccccatttcgagatgcattcataacatacgaacgatatgatttacttattattttactgattccgaatagggaaagtcaaaaaagcaaaatgtgaattcacagcttttatcctacatgcctcgattttccacctgtttgacaagcttatctttaaatgtctgaaaaggaacatgttcattctgctgatgtccgaatcggcggacgtttaccgcattctcctgctcctcatgatctccaagcaccagcacgtacgggattttctgcacctgcgattctctgattttatagccgagcttctcattgcgctcatcaatgccggctcttatccctgcctgcttcagctccgcctgcacctttctgcaatagtctaagtgaacgtgcgaaaccggtatgatttgaacctggagcggtgcgagccagactgggaaagccccgccgtaatgctcgatcaaaataccgaagaaacggtcgatcgagccgaaaaccgctctgtggatgacaacgggacgaaccttttcattgtgttcgttgatatatgttaaatcaaatttttccggcatttgaaaatcaagctgaattgtcgcacattggtggctccgtttcagggcatcttttatgtggaaatcaattttcggcccgtaaaacgccccatcaccttcattgatctcataagagaggccaagctcctcaaggacgcgtgctaaggcacgttccgacgcttcccaaaggctgtcatcgcctaatgaatcctccgggcgagtcgaaagctcaactgaatactcgaaaccaaatgtccgatatacctcatcaatcagccgaatcgcttctttgatctcactctcaatctgatcctcccgaacgaaaatatgggcgtcatcctgacagaacgtccgaacgcgaagcattccgtttaaagcgccgctgtattcatggcgatgcacctgtccgaattccgccatgcgaatcggcagatcccgataagaatacaggctgtttttaaagatgagcatgtggccggggcaattcatcggcttcattgcgaatcttgtatcatccacttctgaaaagtacatattgtcgcgataatggtcccaatggcctgactgctcccataaccgctgattcatcataaacggcgtacgcacctcatcgtagccggcatttgtttgcagctcacgcgagaagcgctccagctcattgcggacaatctgccctttcggcaaataaaacggcatccccggcgcttcttcagaaaacataaacagccctaactgtttgccgagcttgcgatggtctcgttttgccgcttcttccagcatatgcaggtgcgcatccaaatcttttttcttttgaaacgcaaccccgtacacccgctgcaggacttcatttttactgtctccgcgccaataagcgcctgatactcttgtcagtttgaacgccttgatcatccctgtagaaggaagatgcggcccgcggcacaggtcaacgaattccccttgctggtacagtgtgatatcctccccgcgcggaatatcctttaaaatctcaagcttgagccgctcgtctttttgtgcaaacagctcttcagcttcttcgtaagaaacctctatacgtttgatttcaaggttctcatttattatgtttttcatttctttttcgatggcccctaagtctcctgatgccaagcttttccccagcttcatgtcatagtagaagccgtctagaatcacaggccctacccccaatgacacttcgccgtacagccgttttactgcttgggccagcacgtgcgctgttgtgtggcgaagcacctgcaagccttcttgtgaatcgagtgtgacaatcgaaagctcagcatcctcctccagcttgaaactgagatcaacaagcttgccgttgacctgacctgcggccgccttcttttgcagactggaactgatagaaccagccgcttctttgattgtgatgcctttcggatattcctggatctgtccgtccggaagctgaatgtgtacatttttactcattttaaaacactccttattcattgttgtatataaaaaaacacacccgtcccgcagatagggacgagtgtgtgattaacccgtggttccacccaagttcccgacaaatactatattgtcggctcggtgctgtaacgcagcatagacggcattggatacttcagttccccaatgctgctccaaggcggtaaatgatattcctaagctgggaagctctcacctttccttccctctctgaaaaccgtaactatcattcgtgtccttttcaacgcatttatgtagttcatataaaaaaacacacccatccctctaaaagggacgaatgtgttgatcatccgtggttccacccaaattcccgatcaattacacatggtgatcggcttaaagatgctgtaacgcagcatgacggtatcagatacttgttttccccgatacggctcaaaggcggtaagctgctttccctgcgttaggaagatctcagctgtccttccctctctggaaaccgtaaaaagcatctcgtgtccttatcagtgcctgttgtttcaataattttttacatcttactatatattcccacaaagtgcaatcagtgatttacattttttctgacgcggcagtcccgttatgggcagccagaaacagccatacaagcaatgcagcgaggctgtatgcagcccccatcatcaaaaatgtaaacccggcaccggcataccaagtggcggacagatgaatgatcaccccggttatcgctacgccgaccaaggctccgatttgccggtttgcatttaacgccgcaccggcgatattcgcatgtctttgcccggcagcctgcatgatcacagttgtcatggcaggaactgtaataccggtacagaggttcataacagacatcaacaccgccagctgccaataaggaaaatccggagaaatcagcacaaacaacagcaatgcaatgatacagctgaccgccattgatacaaacataagctgcccggcttcaaatcgattcgccagacgggcaaacagcagattgccgaacacgaagaccgccatcatcggcagcagctccactccagccataaaggaacttgcccctcctgcttcctgcaaaaaaaggctgagcataaacatgccgccaaaaagggcgaaattcagcaaaaacccgataaattgggcagctgagaagcggccgtttttgtataaggacgccggcaggatgggtgcttttgcagaaatttcccgcagcaaaaacagcacaaatgccaaaatcgctgcagtaaatactacaagaatcactggcgagcgccagcccgctgaaggcccctgtatcaaagcataggaaagaaacccgagagccatcatgccaagcagatgcccgatgatgttcacgcggctgctttttcccggaacgcggctgaggattcggtaagctgaaatgagcgcagcagcccctattggcacattgatcagaaaaatactctgccagcccgccaactctaccagcacgcccccgataaaaggcccaagggctgaagcggcagaaacaagcgcggcccacagcccaaacattctcgcccgcgcccgctcatcagggtaagaggcagccaaaaggctgagtgagcttggcataaacaaagctgcgccaattccctgtataaggcgtccggcaatcagcatctgtccatttatagatgcagcgcataaacaggaggccagaacaaaaacggctagacccaagatatagatcgtcttcgagccgaaacggtcagccaaggctccgcccgccagcagaagcgacgcaaaagtaagaatgtacccgtccacaacccacgttacacctgaaagtgacattgaaagagtgtttttcatatcagccatcgccacattcacaacggtcacatcaagagttgccatgaggaaaccaagtgcgagcacgatcagcacggatatgcctgttgatgatgttgattcttgtatagacccactatttttcattacaattgccctttcacttgcttgattacccaatcatctattttttcaagatcatacaattccccgactctgtccatgacatgctgcaaggattcttctctcataagattggaccatttatcctcgatttcccccatgactgtctccagcacacagtgactttcaccctcaaatacagattgcagcaggcctttcccctgatacatcgaacctctgccttcgaccgcttgataaacatcataaagcgtaatgtcagccaaaggcttcgtcagggtaaaaccgcccttcgtccctggcaaggattctgccaaaccggcttgaactaatgttctcatcagcttcttcaagtaagacggagacacgcgcaatcgctggcttatagcctctgacgtcaaagaagcctgtacaggcagccttgacagtaacagcagcacagaaaccgcctgctccattcctgatttcattttcatcctattcactcccgattcattatggataactattatccataatgaatctcttagcagcttttgtcaataaaaaaagcaaaagaaacgattcatttcttttgcttagtatggttaacaaatctgcttcagttcctctatgtattgaagcgcttcgtcatattcttcatttgtatatttttgcttgcttttgatggtaaagactttttctttcttttcctcatcctcaagcccgtcaaagtaaaggatcgtggaaaccagctctaaaaaccgtgatgaacggctgtttacactgtcgatatagcctttcatatccggcatgtccagatcagcatggtctaaaaatgcggagcctgtctcagtcagcgaataccggtattgaaagtagccgccctttttttccttcacctcatgcagaaatccaaggttgcacagctcttcaatctggagcgtcagttcctccgaatacggtccataaaagtgaaaatcatatttctcatagaaaggaaactgcattttcttggcgatataaatcattttctgcagcttctttcgcccgatgatttctccagaatccgagaacaccttcatcagttttgcatgttctttcaacaaattcccgacatctcctttttccttctttccaatttctatgtcagtcccagcagctgccggattttcattttcgcttccggatgttcagagccgtcacaaatcaagtcctttggatagtacagcttgtggtccgtccgccgtttacctgagatggattccacaatagccgactgcctggacagctctttaatttggccgttttgcgtcaagagatggatcggcagacgctcctcttcctctcccggtcggtaaaaatcgtatggcagatctgatgaagaatcaacgaccaaataatagctcggatcgattcccgcctctttgaacaatgaagtcagctcaaaataagccgacatttcttcattcggattgaattcaacgtattggaacagctggcggttaatgaatctgcggcacaagtcggataaaatcgcgtcttcttcatcctcccaggcctggaagtaatacaaaataatagattcatccagctttacataatcctccagtgtcaatttcccttcaaaaatagaatagaaatgaaccggagcgtgagtgaagacatagccttcatcgtgcagctgcttcgccctgtgaagaatcttcgttaaaatgacctctgcacttctggtcacaggatggaagtagacctgccagtacatttggtaacggctcatgatatagtcttcgacagcgtgcattccgctttctttaatgacgatctgatcctcgcgcggccgcatcacccgaagaatccgctccatatcaaaatggccgtagctgacgcccgtataatatgcgtcgcgctgcaggtaatccatgcggtctgcgtcaatctgactcgaaatcaggctgaccacttgcttgtttttatatgttttggcaatgacttcagcaacatcctgagggaaacccgggctcacctttctgagcacctgattaacctccgtgtctcccaaaatgatacctcttgtaaaatcctcgtggtcaaggtgaaagaccttttcaaatgaatgcgagaacggcccgtgcccgaggtcatgaagcagcgccgcggccaaacagagttcgcgctcactgtcatcccattcagggcggcctttaaagacgtcatcaaccattcttctgacaatttcatagacaccgagagaatggttgaaccggctgtgctcagccccatggaacgtcaaataggtcgttccgagctgcttaattctgcggagacgctgaaattcacgggttccgatcaaatcccatatcagcttgtcccgaacatgaacatagcggtgcaccggatctttaaacactttttcttctgataattttccatttggatacgccatcgtcattccctcttttttttagccgtgtttctattatatcgactctattctttgaaaacatccttgaatttgcccggcgatttgttccatcttcatgaaaaacacatcttgtgaagcaaaaaagcctgacctgagggccgaggctaagaaaaaatatgtttttacttttttattttcttttttactttgtcaatcagctcatcctctgtcggagctgacagcgggcgattgttcacaaaagcaaatgattttttccgtccgggcccgcaataagattggcatcctacctcaacctttgcgtccgggtccacttctttcaaacgcggcagcaatgttttgatattagtggcttggcaatcatcacacactcgaaattcattagccatgacgtacgcttcccttcatttctatgttcatctatgtgaataacctaaaatcacgtttcaaaaaaaatcacatcactcttcattttacaaggattcgactgttcctgcaagccgctccatccttcgtatctcctattctttcagccaatttgtataaatattttccaacctggacattctaataccatgaaaagaaaaatgggagttgagataaatgacaaaacagcgacaagacgcttggtcagaggaaaacgatctgcttttagccgaaacagtgcttcggcatgtgagggagggcagcactcagctgaacgcctttgaagaagtcggcgataaattaaaccggacatccgcagcctgcggattcagatggaacgcagtggtccgccatcaatatgaaaaagcgcttcagcttgcgaagaaacaacgaaaacagcggatgagagcgctcggaaacgggcagcccgcgaaaaaaagattattatatcagcctcctgccgttgatcctgaaatcattcaagaaaccgctgcagaagagccggttaaaacggaaacaccttctgtcgaaaatgagcaacctttaatgtctggcgaacatatgccttttgttgatgaaagctttaaggaagagttagctagtctatcacacttattgtctcctcaaacgcctgcagctgcgcctgagatgacgatgaatgatgtgatccgcttcctgcagaattacaaaggcaataacgagcaatcatcagcattaaaaatggaaaacgagcgtttaaagaaagaaaatcaggaattgcaaaacaaaacagagcagctagaggcagaagttcaaaagcttgaaaaagaccaaaaaacgatccaagaagattatgaaaccttggtgaaaattatgaacagagccagaaagctagttttatttgaagaagatgaacatgcctctccgtccttcaaaatggaccggaacggcaatttagaaaaattagcggaatgacatagaaaaatcccaaaacgggcagctgttttgggattttcgccatgtgcaaaatccccttttctattgagaaaagagaatttcctcattttgcagccggatcagctattcttgtaaaatgaggccaagcttatgtgaatctattaagacatgtgagctgcctcggccgttttttgtttccgaggcgcagcagaaatgaccaaaagccccagcatcataagcgcaatgcccagccacgaggaaggcgaaagcatttcccctatgaaaaacacgccaagcaatgaagccgtcagcggttcagctaaagacagcgtgaccgccgccgaggccggaaccccggtaagccctttcgcaaacaaaaagtatgcggcacatgttgcaattaacccgatgtaaaggcttgttcccagtcctctaggggtcaatatccacgagatatctaactgccataatagcggcgtcagcaagatggcgctgatcatgaatacaacggcggaggtcgctcgcggaggctgggttttcatcatcgctttactgatgagcgtatagcctgcaaaagaagcacccgctccaagcgccataagaacaccagccacatcaatccgaacattggaactgtcggaaaacagaagccagcaacccgctaaagccagcacagtcgcaatccaccaagagtttcgcgggcgtttcttcaatacagcccattcgagggtcccggcaatgataggcgcactgccgatggcaatcacagttcccactgcaattcccgtttctttaaccgctgtgaaaaacagcggctggtaacacgccatacaaacagcggctaaaaatacgagcggccatgaccaatttttcacgtgaagctcccggctgatccaaaccgcaagcagcatggcgcttcctcctattaataacctgaacgctccaaatgccagcggtgtggcgctttctggagccaacgcctgaacggttcccgtagttccccagaaaaaagccgccatcaatacaaaaaggctgtaaatattccccttcatctgcctctcccctttaatatggatgctgatgtcattttatcgtttttctttttgtcgtggttatctgtatgtaagaaggatttatctgaaaataagattgtggggtaaaatgctgcttgaaataaaaaatgtatgccggcatatacagccggcatgcgaagaacgttcacccaaatacctttgcattccgctcagccatccggacgaggtttttctcaaattccatttcctcatcaatggacagtccagctgaataaagatgggtgcttaacgcttttaattccgtcaataaagcgaacattaagtcttgtacggagatgtctttttgcagaagctcacttaaggacgccatcgtttccggacgtatttccggatagacgccttttttatcgttttgcttgtctttcagcgccgcttgatagaatcgtctgatcaagtcggccctttcactgccgcttttatctgcacagagataaatttgaacagcgactccgccgcgaacgcgtctctgagagatgccggcgaactttttgccatttatactgaggtcatagctgccgggacaataagacccttcaatttcataggcttcgatctttgcgttgtacggtctcagcattcgtctcatcagctcgaccatcgcttcatatcctttgtctatatcgatgcctttcttttcgtcctcgaatatgagagagatatttaaaacaccgtcatccaatacgacggcaagaccgccggaattgcgtacgatcacacggtatccttcgctctccagcaaggagataccatcctgcaaaaacgggaggcgtgtatcctgtattccaaggacaattgtatcgtggtgcacccatgagcgcgctgtcgccggcgacacgccttttccgacggacatgcatagcgtatcatccattgcgaaggattgcttcgcatcaaataaagggccgagactggattggtcaatgactctccatttcggctgcatcagtaaatcaatcggttggtttgccatctatgtaaaaccctttcatgttaggcttattgaacgaaaactattatatcatttcagcagctgtgattgataattgcttttcagcatcgtaataaaaatttctttattttttgtattctccatgagaggagaatgaatgtaagacagcttgcgctttaacgagaaattattaatatgcagaattgaaatttcgcggtggatcaaatccttacgcagcacgcttctggatagaaccgaaagtcccatgccgttaatcaccgcttcctttacaccttgattgctgctgatggtaaacattgatttcggccgaagtccatttgaactgagtacatgatcgagatattctctcgtcccggagcctttctctcttgtcacccacgcttcgttctgcaaatcgctgatcgaaatctctttccgcccggcgagcggatgctgatttggagcggcaatgcacatttcatcctccatgaacggttcaatttccagctcattctcgtttgtatgtccttcaatcagcccgatatcagcctgaagcatacgcacacgctcgctgacctcctctgtattgccaatcatgacatcgaggttcagctctggatacagcttttgcagctgggccaatagcggcggaagaatatactcaccaattgtaaagcttgcagctattttcaattcgcccttcacatagtgatgatgcgcatagatttcagccttggcttgttcgtagagaaacaccatttgctttgctctttgatataaaatgtctcctgtcggcgttgtcgtaaagtgttttggcgacctgttcagaagagccgtttgaaattctttctcaagatttttgatatgcagactgacgctgggctgggagatcatcagcttttctgccgcttttgtgaagtttttttcttctaccaccgctataaacgttttcagcacgtcgtaatacaaaaaccccacccctgtcattaatgaaatatatggttatgattagttttctttattgtactcatatcatccgtcttggtaaagaaggctatacagaagcgcaaaaaaggcagccctcggtcgagagctgccatcgtcttcatttttattacagtgcttgcgccgctgtaattaatgcgagattgtaaacatcttcagcgttacatcctcttgaaaggtcgtttacaggcatatttaaaccttgcaggattggtcctacagcttcaaagttgcccaaacgctgagcgattttatagccgatgtttcctgcttcaaggcttgggaatacgaatacgttagcgtcccctttgatctcggaatccggcgcttttttctcagctacagatggaacaaatgcagcatcgaattggaattcgccgtcaagtgtcagttcaggcgctttttctttcgcgattttcactgcatccgctactttttctgtttcatcagattttgctgagccttttgtagagaagctgagcattgccacgcgaggctcaatgtcgaacatttttgccgtattggcactttcgatcgcaatctcggcaaggtcttggctgtcaggcgcaatgttgatcgcgcaatctgcgaatacgtattgctcttccccgcgagccatgatgaacacgcctgaagtctttttcacgccttcttttgttttgatgatttgaagagccgggcgtacagtgtcagctgtcgagtgagcagctccgcttacaagtccgtctgcaaggcctttatacaccagcattgtaccgaagtagttctcgtctaataacgctttgcgagcctgttcttctgtcgctttgcctttgcggcgttctacaaatgcttgtacaaggtcttccatgccttcatatgtatgaggatcataaatcttaacgccgtccagcgtaaggttcaattcttttgcttttgcttggatctcattttcattgccgatcacaatcggattcagcactttgtttcctgcaagcttgctgaccgcttctaaaatacgctcgtctaagccttcaggaaatacaattttaacgtcttttccagctactttttcttgcactgttgaaaataaatctgccacaataaaacctcctcaaaaagttacaaaaacgctttcttttactagcatactcttcttccaatcaaattcaaacagccaactttcattatagcgctttcataaaaaaatcttatttttctaactaatttaagtgactcaatcttcccttataggttcttctattttgatggagttatacggaagggatgttcaaggtttctccacagtagaatcggataaactatggtatagtgaaggcaatcatgaaaagataatgggagtgaagataaatgagtgaacagcaaatgacgaatgaagctgcaaaaacgcttgacggctggtatgcgcttcatgatttccgcacaatggattggacttcctggaagctgctgtccagtgatgagcgccaatctatcatacatgaattcaccgggttgcttgaaaaatggggcgtagcccaaaaagaaggaaaaggatcgcaaactctttacagcatcgtcggccaaaaagctgattttatgctgatgatccttcgtcctacaatggaagaattaaatcaaattgagcttgaattcaacaaatcaagacttgctgagttcaccattccggcatactcctacgtatcagtggtagagctgagcaactacttggcaagcggtgacggcgatccttatgaaaatccgcatgtgcgcgctcgcctttaccctgaactgccggaatcaaaatatgtatgcttctatccaatggataaaagaagatccggcaatgacaactggtatatgctttcaatggaagaacgcagaaacttgatgagaagccacggtttaatcggccgcagctatgcgggcaaagtcaaacagatcatcaccggctctgtcggctttgacgattacgagtggggcgttacattatttagcgatgatgtccttcaattcaagaagctagtgtacgaaatgcgttttgacgaagtcagcgctcgctatggcgaatttggttcattctttgtcggcaatcacctttcgcttgatacacttcctcaattcctatatgtataatatcccctcccgccctatccggcgggagtttttcaatcctcctttatcagaatttaaataaaatttgctattttcttcgttttttcttacgatgtagataataatccaattttttcaaaggggtgcagttatttgtcaaaacgaaccgcatttgttatgggagccagtcaagggatcgggaaagcaatcgctctgaaattagcagaccagcatttttccctcgtcattaattcgcgaaatttggataatattgaatctgtcaaagaagacattttggccaagcatcctgaggcgagcgtcattgtccttgcgggcgatatgtctgaccagcatacgagagcgggcatttttcaggaaatcgaatctcaatgcggacggcttgatgttctgattaataatatcccgggcggcgcgcctgatacatttgataactgcaatatagacgatatgacggccacgttcactcaaaagaccgttgcctatattgacgctatcaagcgtgcttcctcactgatgaaacaaaacgagtttggcagaatcatcaacattgtcggaaatctatggaaagaacccggcgccaacatgttcacaaacagtatgatgaatgccgctttaattaacgccagtaaaaatatttccatccagcttgctcctcacaacattactgtcaactgtctgaatcctggttttatcgctacagaccgttatcatcaatttgtggaaaatgtgatgaaaaagaacagcatatccaaacagaaagcagaggaacagattgcttccgggattccgatgaaacgggtcggatcagccgaagaaaccgcagcgctcgccgcgtttcttgcctctgaggaagcctcctacatcacgggacagcaaatttccgctgatggcggcagcatgaaaagcatataaaaacatcccgctttttagcgggatgtttcttgtaatgacccgaacggcaggttcagcttttgaatccgcgtgacaaattcccgcagatcctcctgcttcgacaccattgagattctgacatgcctttttccgttgcttccaaaaatttcgcccggtgtgactacgacatgggcatgctccagcaagtaatcggaaaattggtgagatgtctcaaacgtattcggaatttcagcccatacgtaaaaggttccttttggcttttccatcttccagcccaattccttttcgcaaagcgccgtaaaaaagtcaattcgttccttataaattcgtttcaacgattccgtatgctccggatctccagaaagcgccgcactcgctgcctgctgcagcccgccgaacatgccgacaaatacatgatcctgaaattcattgacggcctgaatgatcttttcgttcccaaccgcaaacgccattctccagccggccatgttaaatgtttttgaaaatgaataaagctctgctccgacaattttggcatcctctgcctcaagaaaactggccggtttttgatcgaattcaaacgctccgtatgcaaaatcatgaatcaaatggatgttatgctctttcgcaaaagcagcagctcttgcataaaaagccgcatcagccacagctccagtggggttgttcgggtagtttaaaaacataagcttcgctttttccagcacggctggatcaatcttttcaaaatccggcagatagccattttcttcatacagcggcatttcgtaaagctcagctcgcgccatcgtaatccctgataaatattcaggatagcctggattcgggactaaagcgatgtctcccggattgagcaggcattgtgtcagcacatacaatccggctttcccgcctccgaaaagcgcgacttccgtttcaggattgattgtcactccgtattcccttttatagaaagcagcgatcgcttcctttaaaaaaggatagcccctgaaagggccgtatccatgaaacgaaggattcagagaagcctcccgcaaagcctccacaatatgcggcggagtgggaaggtcagggttcccctgtccgagattaatgatatgggcccccgttttttccaattcctttaccttttgaaaaacgagagaaaactcctgccttggaagtgtcttgatgacatcggacggtgttatttccatctaaaagactcctttttgctccgttttgttatcccgttccaaaaacgatttgttgacgagcttcgtatgcagaaacaaaccgcatacgatcacgacaatcagccccataatgaccggagcgcttaggatgttaatgaacattgaaccaatagaaatgcataatccgatagacgcttcggccactgaaaaaatgcgcccttgaatctggtttgccgcattttcctgaaccttcacttttgcaagcacttccccgtattccatcgcgatgaaaaagaggatcgccgcgatgacagaaacagcgaaaatcggcgtgaataaaaacagcgccagtgagacaatggataaaacggtaaagtacgtcaggcctctattgttgttaaagccccatttgctgacaagcaccgctccgataaagccgccgaagccgatgcagaacgtgagaataaagttgccgatttccccgtcacccagaaagcggctgacaatcggaaaatagctgtacacaactccccacagcaaagccattgtaatcatcgtaaacatggcgtttaatacgaatgcattggttttgatttccttgagtccttccttaaaagactgaaaggcctctttaatgttttcagattgaatcggcacaaattgcagcttgatacggctgataaaaaatgccgaaaccaggtatgtcaaaccgttaaaggcaacagccagctctacagatccacctaacagaaagagccctccggcagccgccccgacgataatggagatggttgtcgcttttgcaaataacgtgttgatgcttttaatatctgattccaaggacgacatgacagcgagacgggcgggattaaaaaacacgccgcttccataagaaataaacagcagggccagaaaaatcagcggatactcgccttttggaagaaatgtgagccccaaaaagatgatgcctctgatgatatccgtccacagcatgatcttaattctgtctaaccggtcgaccagaacccccaaaaacggctgaaacaccatcggaatgcttctgaccacgatgaccccggacgtcacccaataatcgtgataatatgtagacaaaatgagcagggcagggagaacacaatagtctcccatgaacgatagcgcctgcccgtaaagcaagtatttagagttgggtttcagctgtttcatactggcagcacatactttgccgtcagctttgcatgctgctgaatttgtctgattgattcagccacatcctgtgaattactgcctttcagttcaaatgcagcaatggaattgaaagcttcaaacaatgtcaaatcaattgaagtgcctggtgctgcggccgaaaaagaaacgatttcagtatccccttttaaaagcccgtccggaatatcgatcgcttcaatgaccaaatcctcagcggtttctggaatctggccattttgtttgaaatgctgcgggtacaaatggcagtcggcgacatagtaaggctcttgatccaataatccgtccggcagatcggcatcttttccgaaacagaggacatctaataataattgcgccatatcaaggccgaaaacctttttaatgttagggatcatattccagccggcaaatctggctgccgattcaattaaacccggttctctgtttttcattagcttgacctctgtatgtgttgcgcaattttgcaggccaagcccttcatttgcctttttggcagcttcgacaattttcttttttgcctcttcatccagaatggacggcgtaatgtgggatgtctctgtaaacccgatttgcggcgttttatcatgaatggcgatcgggaaatactcaccgtcagccatgatgccttctatactgatatagtcggagtacccttctgtttgataccagtctccgtactcaccctgtaaaaattcttcagcgataaacggcgcttcaaacgtaaccgcctttggcacgttaattgatttcagatagtcattgactctgttaaattcatcttctgccgtctcagtgtccgtaatcagcgttacaccgatagaactcgctaagtatgtaggctttaagataagaggtgtgccgatctcttcaagagcagcacggaaatcttcaagagttgtgactcgtttgtttttgatcgatttgactccggccttattaaaagcgtccctcattttatttttatctctggcattttcggctgcctgcacgccggcacctctcaagcccagacgttcacaggctttcgccatcggagcaatgaataattcattgtttgttgtgatggcatccgccccaaacatttcggcaaccttgacgatttgctcgacgacctcttcctcaggcttgttatgatcctcatgcgcccaataaatggagtcaggatgctcaaaatcagctaaactcttaaaatagtctttatcttttacgaccgcgaccgagtatttttcaatcaatgctgcatgggaggctgtaattgcaaaaggtcttggaataaagctgaccaggttatatttttcagcagcgcttttataaaacatgtgcggcgggcagcctccaagatcagcgatgaccaatactgtttttctctccatatgtaaaacactccttctctattgtgcggtgtatcctccgtctgcggtgatggcgcttccggtcatatagcttgataaatccgaggctaaaaacagcatcacgtttgcgatttcttcaggtttcccaagcctcagcagcggatttaccttcgccttttcttttttgatctcttcaagtgtgccttcattattttcaaggaatgatttttcattcagcggtgtgtcgatgatccccgggcatacgcagttcacgcgaatgtgatgcttcgcataatcaacggccattgatttagtcagctgcaaaaccccgcctttgctggcgttataagcaggaatatcaggccatgccacgagtccgccgacagagcacgtattaatgatgttgcccttgccggcggccagcatatgcttgagtgcatgtttgctcattaaaaacatgccggtcaaattgacttgcagcaccttgttccaatcgctgagctccatctcgtgaataggcgccacgatttcgatgcctgcattattaatcaagacatcgagcccgccaaatgtatgaaccgccgattcaactgcgtgctggcaggcagcttcgtctgtgatgtccgtttgcacaaagtgcagcctgtcattattttcttttcgtaccattgcttctccctgcgcttcatcaatatccgccacaaccacattggcctgctggcccaaaaaagcctgaaccgcagcataaccaatgcctgatgcgcctccagttataaggacggttttatcggtgaggttcatgatcattcatccgccttcattttttttgcttttgctctgttgtagcgcggcgggaagaagatattaatcgattttgattctttttccgaacggttgatggcaccgtgatcttcacgaggctcacagaaataggctgtgccgaatttcatctcgactgtgcagccttcgaccgtcatgtcatagccgccgccgatgcagatgcctatttgttcattccgatgtttatggaaaggcatttctccgccatttccagggattttggcaagcataatttctacccaatcctcaacaaagaacgtgacttccatgcccggcagcaggtctcttgttttgaaaatatccaaaaagtagtcctcaggacttgtatatgtttcatcagctttcagccgcttgatatcaatagcaatcacttcttggtctgtgtcgtttcttgccccatgtggcacatgcggcggcgcgatataggcagattccaaggctgtcatttttcttgtcacatctccgacagtcatcatcagctcgccagaaacgaccatgccgatttggacctccttatgctgatggggttcaacattggtatgcggcgggacgtaagacattaatacttcagtatcccctcgtacggttgaatactgcctcactccgttttcccattcaattaatttcggtgtcgggaaataaagctcctgcatatcttctttagttttcatcatcaacgtctccttttccaaataatgaccagctcattggaatgcttttgaatgtttttacaaaggttagcccgtacttttgccgtgcaagctcattggttaaggcaatgtcatacaaaccttcttttacttttcttgcggcttgactggttgaattgactagtttgaaacgaacatctttgcgggtaaaatattttattaaattaataggtgaaggatgtgaaacaataacagatgtatcaagcatatcgtctctgaattcaaaatcaggacgaacagccaggccgtacatcggtgtatcgcacctgaagatctgcaatagctgcaaatccggcctcatgtagaaatgcttaatgccatcgtaagcatgtgggacgatggtatattccagcgggctttggagcgtcctttcgatgcatgattcaaaagtatcatgcaaggacaatttactgttcagcccttgtagaagagtaaaattggaaatgaaatgctttgctgcgtactcactgcttgtcccctcagggccgagcgtgttgactgtaatgagtttggatagtgaatcagttcttttttttgtctgaatgctattatccaatataatcatgagcaccaaccaatcttttaaaattttaagtaaattttatccagcggcaattgaactgtcaatgttttttgaaaatattgataattattcccatacaaacaaaaaaaccctttaaaaagggtttttaattataggaatttagaaactttgtttattgagataaggactgatcggccttctgctcaagcttgccgtactttttatatgcgaatatactgagcacaaatccgaggactgtgatggcggcgcaaatcaatccgacagctgcatagccgtatgccacatatacgggtcccattaaagcagaacctaatgtcacggccagattcgaggcgaggctgtaaaacaccatgacttttccgcgatgacgttctgagcagtcactcaaaatggtgctgagcagcgtcaccgtcaaactttgcattaatccccaaataaataggctgacgattaacagaaacattgacgccggcgcatatggtaaacacgccagcagaacgctgatgacccccagcgcaatcaaaagggagcgcatttttccgatgcggtcggctatctttcctgtaatcacactcatggaaaacccgattccataaatcatgataaataagcccgcagccgtgtttcctccggtaaaaacgtcctgaagataggtgcctaaaaaggaatacataccgtaaaaaccaatcatattacagaaggttatcgtgatataaacaggtacacgagggactttcagcgcatcccggaatgttcctgccggctcttctatttcttccttgccgctgtttttatgttgggcatggcggcgcatttcaaggagaatcagcaggacaactaaaacacccatcagggcgaaaatccaaaacgtccatctccaatgcaggacgccgccgataaatgatccgagcggcactccgaaaatcagcgccagcgaccagcttgaaacgatcagccccatcaccttgccccggtatgtataaggaacacgatcaccgacaactgcgtaagcggtcggaacaaacgctcccgcagccaatcccgaaagcgcccggcctaaaaagaagaaaaaaatattttgagccaaagcgcatatcaccgttcctatgataaagatcataagcccggctaataagctcagttctctggagtatttatcgcctaatggaaccaaaagcggcgcaccgataaaaatcataacgccgtaaatactgatagataatgcaaggacgctgacatctgagctgaaggcttttgctaaatccggcagcagcggtgagattacaagctcttcagatccggccgcaaatacccccatcgttaaagccagtgccaacaataacggaaaatgatgttttgttttgatgtcattgttttgattgctgttcattctttctcaaacacctcttccataatcttcttatcataaagttgtattatagtttagcattgttttttcactatttacaattcgaacgaaatatttataagttttattattttcatttaaatcccattatatatttctatatttcattctaaaaatacatgaggatgtaatgcgtaaaaaaagctctccggcctcccggagagctttttctattgtgcctctgtctgctttttttcaatcgtttcatgatttatacgctttttgatgcttagatgatagtatgcataacagaaaataatgatcggcacaccgcagtataagccaattctttgatccggaatgaaaataaggctgatcaacacgcagccatataaacaaaatccgagaatcgggactagcggataaagcggcgttctgaactccagatcattcacatttccgccttctgcaaggaaacgtctgcgaaagaaaaattgcgacgcacaaatggacatccacgcgacaactgtcaccatgcccgagattgagatacaccataaatacactgtttctgcggccatgacacttgtcagcagcgaacagcctgaaatgcctagcgtaatcagcagggcattcatcggcacgcctttttttgtcagtctggtgagaaaggatggacccatttgatttgatgaaagtgaccacatcatacgcgacgccgcatacaaccccgaattagcaacagataaaatggctgttaagatgacaaagttcatgatatctgccgaaaatgggatgccgatttgatcgagtaccgctacaaatgggctttcaatcacccccgccgttttgtacggaaggatggcaaccaagacgaacatagcgagcacaaagaaaaacagcgtgcgccaaatgacatttcgaatggactttggcagtgttttttccgggctttcactttcccctgccgcaatgccgacaagctccgttccctggaacgagaagttcaccatgaccagcgtaaacataacggccagcaccccattagggaaaagtcctctatcagtcataaagttagacaaaaagggtgtctcctgtccgcctttaaagtcaatcaagccaaacacagcggctccgccaatcacaataaataatatgatcgccgccactttgatgcttgaaaaccaaaattccatttctgcaaagcttctgacagagagcgcattaatcaaaaagatgacgatgccgaacacgaggcaccatatccagatcggaacggagggcagccacctttgcatcaaaatgcctgctgacgtcagctctaaccccactgtattcgcccagctgaaccaatacagccagccaatcataaagcctgtcgacggtcccagaaatttagtggcgtaggcctgaaacgatccggccaccggcatggcaacagccaattctcctaaacaaagcatgacgagatacattaaaaatccgccgatgatataagcggcaatggcgccgagcggtcccgcctggctaatggtaaagccagagcctagaaacagcccagtgccaatcacccctcccaaagcaatcataaacaaatgcctgcttttcatgctgcgctgcaattcatttttatgattctgcatcatccttccccctttggttcttttgccgtgatggtcatccggtagctttgcaaaagatgaacggtggtttgctgtatgaggagaggcaatacatgaaatgtgtacggtttatagactcgttctgtccatttatggccgtcttttccgtacacgcccatattaatggatggaatattcagcttgcgtatgtctttgaacggaatggtcccaatcatattccacccagggaagttcctgataaaagaatcaatttcgccatcggtttcgtgcagtgataaaaaactgccgtctgccaagtaggggaaaaactttttgaagacaaatgtttcgcctgtcgattcagcggttttgtcagccgcttcttttatcacatgctgcaaaagctgatctcttgcgctatcttctttcaaatagttatgcggcaggtaaggaggtgcgtaaaatagaatgacttttgcgccttgatcggggtcaagcttttgaagctcttcgattgcctgaaagcatctcatgcgaagttcaaggtgctcgttggctttgaatgtctgctcgatacactgctcgggatctatcccccggtttctcagcttttctaagtattgctccaggctatacacttgaatgtcccatgataaatgtttctttggcaggttggctctttttgcatattcttcataataatctgataatttttgttctgtctctcggcatgcttcctcagtgacttcaataagcaaatccatcatttcttttgctgttctttcataaataaaacaattgaagtacaagctggtgctgacagccgtttgcacattataggattccttgttatcacgctgatacaaacaggatgggggcagaaccaactccccttcaaccttttctgccagatggatgttattgtggagacggcttgtgatttcagatgaaatgaaatttgggtcaattcctgccagtgtatcgccaacatggacttcacgcccgtaaatgtaaaagcaaggcaacagttttcccgcggctccggtatagatatatcttgtctgatcaccatcgtaaagcggggtaataaaatccgtattaatagcagccaaatagtgaagctgtttttctttttttagccggttcagctctgaaatgctggcaagaatgcccgaatgctggctctcctcatcgggattggccataaacaatacatttcccggcaacgtctcaaggttctccgaaaaatgcaggagattggctaaatgcacggcgatgccgctttgcatatcaacagatcctcttccgaacatccaatcgcctgatttggcatcccgctgaacatcctgatcgaactcatagcggctgaaatactcggccaatttctcacaatcaaaagcgatatcctttaaagggccgaaatcttcaattccaactgtatccagatgggcatggtaaatgactgtatttcggctttctccatgtcctttaataaacgcaaaaatatttttgcgattgtatgggtcattgggaatggcctgttcccacacatgactggggttttcctgaaaataaggatagctcgtgatcacttctttgatgaaatctgcttttgtcccttctccaacggtgccgttcacgctgctgaggctgaccagagatgctgtcagcgcctccactctttcagccggattcatgtgactgatttttgtatactgcataaattgtcctcctgattaaaaagttgaaatcgtgcgatccgctaaagaatcgcacgattttatttctctcaaatcaaaaagcttcggacgttgttttggcttgcatatgaagaattaagtaatcgggaccgcctgcttttgagtctgttccggacatattaaaaccgccgaacggctgatagccgacaattgctccggtacatcctctgttaaaatataggtttccgacatggaaatcctcacgcgcccgttcaatgtgcgcacggtttttcgtcagaagcgcacctgttaatccgtattccgtgttattggcaatctccagcatatgatcgaaatcacgcgctttgcaaatcgcaacaaccgggccgaaaatttcttcctgcatcaagcgggcgttttcatcaacatctgcaaagatcgtcggctgaataaagtagccttttgaatcatcgccttctccgccggccaatagcttgccttcagatttgccgatttcaatgtatttcatcactttgttgtaggatgcttcatgaatcacgggacccatatacgtatcaggatcttctggattgccgacagtcagcgttttggtcagcgccacagctttttccaccacttcatcataaacatcctgatgaatgaccgcgcgggagccagcagaacacttttgtcctgaatatccaaatgctgagtacacgatagaggatgcagcaaggtcaagatcagcgtccttgtcgacaagcactgtgtcttttccgcccatttctgcaattacccgtttgagccatttttggcccggctgcactttggcggctcgctcataaatccggcagccgactgcacgggaacctgtaaatgagacaaaccgtgttttcggatgctcaactaagaaatcaccgatctccgctccatctcccggaatgtaattcagaacgccgtttggcagacccgcttcctccatgacctcgacaaattttgctgccactaccggggctgcgtcagccggttttaagagaatcgtatttcctgtcacaatcgctgccgccgctgttcccgccataatcgcaagcgggaagttaaatggagaaatgacgatgccgacgccaagcgcttcgtaatgatattgattgaactcgccagcacggctcttcaccggagccccttccttgagctttaacatttggcgcgcgtagaactctaaaaagtctatcgcttcagccgtgtccgcatccgcttccttccacggttttcccgcttccttcacaagatagcttgaaaattcatgctttcttctgcgcaaaatagccgctgccttaaagagaatattcgcgcggtgctccggtctttgttttttccaggaatcaaatgcctgcaatgcggcttgcatcgctttttcagcaagctcttgatccgctgtagacgcgtacccaatgatctcttctttatttgccgggttaatggaaatgattttgcggtccgtttcaattttttctccatttatgacaagcggataatgcttgccgagctgagtgtttacaaaggccagtgactccccaaatgcagttttattctttgcttccgtaaaatcggtaaatggttcgtgtgcgtatgtgactgtcatatgtagtccccctcgtgttatgaaatatatcttcgcatatgaataaaaatgcaagaatcatgccattttcttgtcttttgctgaaaaaacttgttgaatcgaacagaaatttgtctaacaggtgatcatctttctctatttccgatcttgaacgcaaatttattttgcgatttttgctctttaggcaaaaaacaaatgcaaaattattttgcggaggcttctcaaattagacccatccgcggaatcgcgatgcttctgccgattttctgatgcccgtcatgtaagccgccaaacgcatatccactttatgtgttgccgctgtctgataaattgtttcgaacgagctgaccatgacgcttctcaatttttctgcaacctcttcttccgaccaataatatccttggttgttttgcacccattcaaaataagaaaccgtgacgccgccggcactcgccaggatatccggcacaagcagcacgcctctttcattcaggatcttagtggcatcaatggttgtcggtccgttcgccgcttcaacgacgattgacgcctgaatgttatgtgcgtttttggctgtgatttgattggagatcgcggcaggcactaaaatatcgcaatccttttcaagcagctcctcatttgtgatgacgtcagtaaataaattggtgaccataccgaagctgtcccgtttatcgagcaaataagggatatcaaggccgtctgggttgtagagcccgccattggcatcagaaatcccgatcaccttcgcgcccgcatcgtgcatgaatttggccaggaagctacccgcgtttccaaagccctgtatgatgatgcgcgcgttttgcagcttgatcccttttttcttcaccgcctcttcaatacaaatcgtgacgccctgtgccgtcgccgtttcccgtccttgcgatcctcccaaaacaagcggtttacctgtaataaagcccggagaatcgaattcccgcagccggctatactcatccatcatccacgccataatctgcgaattggtgtatacatctggagctggaatatcctttgtcggaccgacgatctggctgatggcacggacataccccctgctcagcctttccagttctccaaatgacattgtccgcggatcacaaataataccgcccttcccgccgccgtaaggaagattggcaatcccgcatttgagcgtcatccaaatggataatgcctttacttcctcttcattaacttctggatggaagcgaacgcccccctttgtcggaccgacagcatcattgtgctgtgaccggtagcctgtgaacactttgacgctcccattgtccattttgaccggaatgcggacagtgagcattctctgcggctctttcatgagttcatacatatctcccggataacccagcttccgaagggcttccttaatgattgtttgggtagacagaaataagttaagagcttctttttcttcatctttcgagacttgctttgctgacatctttttcacctcattgtttttttggccggctgtaatgtaaacgctttaaaaaatcagcccgccaattcctttctgcattggattcacccttatcatcatgcaagatccgtaccagcttttgaatccacaaaaaaagagactgaaaacatctcagtctctgactacaaatctatcgattaacggggatcaatcaccagctgcgtttcagcataaaaactgccgattcccaaaccgtttactacatcgcctttaatcgtgtaagtgcctgcgcgaggaagagttttacgcaccatgacaaggtcaaattcggatgcgcctaacaaatcaagcgtaagcggaagtctgactgtttttccatcgtttaaaatctgtgtttctttcagtgttcttccattcactgaatctcttgtcgtagcatgaaacccgtcaggaaattgaaattctaccgctccaagagaaagcaccgcatttggtttatatgtcacttcaatatcagaagtggtccactctttcgtgctgttaactgtttttgcctcgattgatgcagactgtgcatgagcttggcccgaaggaagtaagattgatagtaaaacagctgaactgatgaataatgaagatacgaatgaagttctttttagcatgacatttccccctaattgattgttgaaatttggccagagcgtcctctgcagaaaaagcgctttttcataattcgcgaattaccagttctttttcttaaaaattaatctatcatcattttccatggaagtaaatgttttttaaggaatattaacacttggaattcaatgagaattccttcctgtttatacaaggttcaaatggacgattctcctctctttttctagtaaaatctgcctgacattttatatcttttatcctattttaaaaaagggcaaaaaaagtcgaagatgcctctgctcttcgattgatcacgttcctatttttatctgaattcagtgttccagttaaaaccgatcgtctcatcatcccacggaattcttttttcatcaggctgatccgggttatacgacatggtggtaaaatagataattgtcagcggcgtctctcccagcactctatatccgtgagccaccccttttgggattaataacagcatcgggttgtcttcgcccatataatagacgtccgtttctccttttgtctttgaatcctctcgaagatcgtataggacaacctgagcgtggccggttgggaagaaccagagatcatcctgcttctcatgataatgaaatgccttaatcacacccggatagcttttcgaccaagaggcctgcccaaaatgctcaaggaggttctcatcgtcccggaccagctcagcaaaaaagcctctgtcatcgctatgcttcatcaattttttcaccttgactccatcaatcacacgcactgctcctttcctgcaaatactctcgtaacgcttcccgccagtggcgggggcggatgtcggcttcttcaatagcccgatggctcagcacagagtatgccggacggggcgttttgttcccgtattcctctgtcgttacaggcaaaatggctgtttccagcccgctttcttccataattgccgtcgcaaactcataccagctgcatatgcctgaattgctgacatgatagatgcccggcggatggctgaacagtttgatgaccgcttctgctaaatccttcgtataagtcggcgaaccaatttgatcgctgacaacccgaagctcttgtttcgtttcagcaagcttcagcatggtttcaacgaaattactgccgccatgtccgtacacccacgatgttctgatgatcgtgctgtcttttgtcgttaatcgtatcagttcttctccgagccttttgcttttgccataaatggttttcggatcgaggggatcatcttccctatatggctgggttcctttcccattgaatacatagtccgtgctgatatgaacatattgagctccgatgcgggttgactcaagcgctgtataataagcgccgattccgttaatcaagtacgctttatcaagctctttctcgcattgatcaaccgacgtaaacgcggcgctattgaccacgatatccggctgataatggccaaacgaatgccgtactgagcgctggtcagcaatgttcatcatcttctttgttaacgcaatgacctcatatccggcttgcttcagctggcggcatagttccaagccaagctgtcctcccgccccagtcaccaatacctttgtcaatcagatcaccttctcatcggtcattgtctgtataccactgaatcgtacgcgcaatgccttcttcaaacgtcacttcctgccgccagcccagttcatttttcagcttagatgcattgatcgcatagcgccggtcatgcccttttcggtcttccacgtgggcgaacaattcctcacagcccagatgcttcaaaatggcactcgccagctctttattcgtgcgttcatttccgccgccgatgttatacacctcgccgtcggtccctttttctaaaatcagcttgatcgcgcggcaatgatcctccgcaaacagccagtctcggatctggagtccatcgccatacagcggaacaggcaggccctgcttcgcatgacggataatcgtcggaatcattttttcgctgtgctgataaggtccgtaattgttgctgcatcgtgtaatgatggccggaagcttgtgggttttcacataagacaacacgagcaaatcagagcttgctttgctggctgagtatgggttattaggagaaagcggcgtcgtttctgtaaacgcgggatcatccgcttttaaatccccgtatacctcatctgttgaaatatgaatcagcttcttggcttttcctttcaagaccgcttccgccaatcggtatgtccccatgacatttgtggtgataaacggctctgcttgggaaatgcttctgtccacatgcgattctgctgcgaagtgaatgacgccatcgtaggtctcatcaaacgcgcggtcgatatcctcctgaacgctgatgtccccttttacaaagcgaaaacggctgttttgctttaatttttccatttcctccgggtggctggcgtacgtcagtttatctaaaacggtaatgcgcgcatccgtttccctcagcatgagctttgtaaacgtgagcccgatgaagccggcaccgcctgtaattaaatatgattttgccatcacttttcgtcctgtcctttccgtaaagcctggtgtacaagctgggaagcgagataaagcgattcgtgagttccggcatctacccaccagcctgataacacatcatacgtaagctggctgttttcgatgtatagattattcacatcggtgatttccagctcgccgcgctttgatggtgatatttgttcaatatatgaaaacacctctgcatcatacatataaataccggtaacacaaaggttggtcggtggctgttcgggcttttcgatgatggaacgaatccgcttgtttttctcatcaatctcagcaatcccgaagcgttccgggtcatcaacttctttcagaagcacttttgctcctttcccctgctgttcaaagcgttctgtataaggctttaatgaatcttcaaatatattatcacctaataataaaatgaaagactcttttttcgtaaagcgctttgcataagacagcccatccgaaatgcccgatgctgccggctgtacttgataagtgatagtaacgccaagctcttccccgttcccaagcagtttgtaaaattgcggcatatgctccttttggctgatgagtaaaatgtcttttattccggcttcctccagcttcataatcgaccagtatatcatcggatacgggcctacaggaagcaaatgcttgttgacggctttcgttaagggcataaggcgtgagccgtttcctccggctaaaataacacctttcacattaacacttccttacatgcatttttatatctcttgttcatataaatcttgaagaatagctgttacccgtataatgcctttgccatccacgagcggccttcctcccttgtgcaaagaaaggcgaagaggatagctgctcataatgcgtgacatctgatagatgagtgtttcatccggtacaagctcacccaagccaagatcaagagcggcgccttggtcagcaaatgttttggctgttgccgtttgatgcccaacctgagaaagaacaaggcacggcacgccgatgcaaatggcttcatatagagagatgccgccggcgacaatggctgcgtccgcttgtttcatcaaacccgccatatcatttgtctgttcgatcaccttgtactgcggcttcttttcgatccgccttcggactgcctcttgatgcggtgaagcgctccccatcacaaaaatcatgtttttgtcttttatgccggggacttgatcagcggcagccagcactttaaaaataagctgcttcggatcacttcctcctaatgcaacaaggatattgcggcagtctttcttaagtgtgtaatcctctcttgcggcctgaaaggcggggtgaagaataagatagtccggaccttcataaatgcgtgtgtttccctgaacgtacaccctgcttctgatgtcaccgtaaattccgttaatgactgcgtcactatattgaattgatttaccgtttttctcttcaaaaagaacaattttcgcatctgtctccgtctttattttctttaacagctctgcaggcgcgcctagaatatcaaacaaaagcaaatcaagcttcttgctttttatttcccggagaataaattcgtgctgctgcagctccggctttacgatgacacgccaatgctcttcatgaagaaacgcttcagactcctgattcgtataaaacgtaatcaaacatcgctgtttgagcccctccgcaagtctcttcatccggacaacatggcccattcccttttcatagccgccgtctgcgaagatcccaacacgcatggctattcagcctctcgttcgattgccgcatcggggttccggttcagaagggtgataagctctgaggcggatacaccagggcgctcgcctgctttttgatagagggcctttatcgattcatagtcttcctttgtatcaatggtcagccgatattgaggggcgcgaaatcgttccggcgcctctaaaaactgaacacgataaagagctggatgattccttatatataacgtgacatgctcctgatattgatcctccatattctgaatacggctgatgtcaattaataggttggcgttgaccacttcgccgcaaatccctaatggggcattcaggatatacgtataatccgatccttgatcaaaatgcgccttaatcattacatcgagcagctccggatcgacaaacggattatcacccgttaaccggatgatgactgacggtttaacagcttctatgaccttcacaaacctatcgaggacacgttcttcgctcccgcggaaaacacgaaagccttgtttgatacagtgcgcctctaatatgtcgtcagtttctttgtcagacgtggcgatgacaagattatcccgatccttttggtaaaacgcgcttttccggacacggtgaacgagaatgtcaagtaaacgattcgatccgagcggccgaagcacttttcccggaagccttgttgaacccattcttgcttgaatgataaagagaatatcattcatgaaacgggctgtccttcagtaaaatgtcatcccagacaatgcctgtgtcggctggaatgtctcttacagcccgaacaccgctggtcagcagttcaaaaaatctcgggtgcagcccctgcggcttttgtccgggccgaagcactgcgatattgtcttcactaaaggcttcacctttttgaatcggagctgttgtaaaaatgcctctgtatgcaaaatttctgatttctccttcgatggaggttgttgttttgtatgaactgccaagcagtttttcagagaccggctttgtgatcccctgtttcagctcagcttccgttttcctgatgccatcgaccatttctttcaattcatccggatttaatgcaaacgagtggtcggcacccggcagatctttatcgatcgtaaaatgcttttctatcagttttgctccgagccgaaccgcggcacacggcgcttctgtcggatgctcgctatgatcggagaagccgattactgcctcaggaaaagcggcggcaagcatcggaatgacgctgaggttgctgtactccggcggtgctgggtatttcgccacacaatgcattatggcaatttgattgtttccctctgccctgatggtgcgccaagcttcgtgaacatcagagatttcagctccggctgtcgagaaaatcatcggcctgttcagccgggcgacatatttgagcagcgggagatggttaatttcataggatgcgattttaaaagcgctcggcgaggtagactgaagcagatcagctgacccctcgtcacataccgtacttaaaaagatcacctgcttttcgcggcagtaatccaatagcggtaaaatccactcagcgggcatttccatagattgaaccaaagaaaaaatagagacgtccttgcccgctgccgtcttgtacaaaccaggatctttctggtacatcctatcagcttggaacatttgaaatttcacggcatccgctcccgcttccgccgcggcgtctatcagcgcaaaagcctgatcaagcttcccgtcatgattaatccccgcctcagcaataataaaaacaggagcgtctttgcctacagttttattcgcgatctgaaacgctgccattatttcgcctccttgcccggccaaatatgataatagtaatacgattgttcagcggtgaagcccattcgttcataaaggcggatcgcccttacattgtgaagctgcgtccccgctgttaccgttctatgcttctgggtctccggttgttctatgagattcgccaataaatgaaatgcaatacgttttccttcaaatcccggctttacagccatcaaatcgagaatgcattcatcatctcttgataagccctgaagatagccgatgacctcgccattgtgtttagcgacaatattgaccgccgcccttccattcagattgtttcgtgtccactcctgaaatattttgtttgctgcatcgcggctgagatgaggatcctgaaaatatctgctttttgtaaacgagtctcgggccagctcacatatcgcttctgtgtccccgggctcaggcgggcccagttcaaaaaatggcggtgttttgtcataaaaagacggaggcatcgccagcttcagcaaactcccgacaaagtaagaggatggctgctgctgtatcacatgcgcggctccgatatcttcagccggaacgcggacaaagataaaatccgtttcatccatttggcgtacagtataaaaagcttcaaacagcctctttagctgcccggtactatttgccgcaagaagtttgacgttgatgactttcttctgaagcaccttgctttcccacaaagaatcttcgtaaagcaatacgccttggagcctgctgttttcaaaaaggccgagggaaaattgatacggaacatccagtgtaagctttctgctttggagaaattcctcaattgcctctttggagacattttcttttaccgtatacacttaatcagccccttttacgatatcccgcacagcttcaatgacatcatctacatcgtcgtcagacattgatggatagagcgggagagaaagggttcgtttatagtaattcatggcattcggaaagtccgcttccttatatccaaattgcttttgataatacggatgaatgtgtactggaataaaatgaacgctagtgccgatattgtatttatcctttaaagccgtaatcatttcgctgcgcgtaaccccggcttttttttcatcaacttgcagaacatatagatgccaggcgtgcctgccgtcatcatggacaaacggcgtgatcagcccaggaatctgctgaaaagcggtttgatagcggccggcaatctcttctctccgtttctgcatatcatccagccgtttcagctgatgaagtccgagggccgcctgcaaatcaaacatattcatcttatagccgggcgattcgacttcatagtaccagctgccatttgaagaataacggttccatgcggctttactcatgccgtgaaggcttagcacccggatcttatcggcaagctcctcatcatcagtcgtcagcatgccgccttcccctgtcgcgaggtttttggtggcgtaaaagctgaatgccgttgcatccccgatagaaccgatcattctttgcttataagtcgtatataccgcatgtgccgcatcctccagcacgaataaaccatgattttgggcaacagccaatattgcatccatatcgcaggactgcccgccaaagtggacgggcacaactgctttcgttcgcggtgtgacggccgcctcaagctttaccgggtcaatattgagcgtgttttcgtcaatatccgcaaacacaggcgtcgctcccgtatgaataatcgtattggcggtcgagctgaacgtaagcggagaggtaatgacctcgtccccgggcccgatcccttttgctttcaaagccaaaaataaagctgcggtacatgaattcaccgccacggcgtgcttcgccccgacaaacgcggcaaactctttttcaaactgctgaaccttcgggcctttagaaagccatcccgattcaagcgtttctgtaacctcctgaatttcttccttaccgattaacggcaatgagtaagggagaaaatgatttctcttttgcaccatttctttgcgctcctatcattttattcagtatcttcccgcctgtaatcaacccctgttttggctttcagttccgcaaataaagcatttgttgattctgccaccggataattagccgctatgaatgccaggcgcgcctcttctgctttttgatgcacgtcgggacttcgaagaacttcaaccaaggtgtgcaccagttcatccggctggtcaaacataaaatcgccaagagactcataatacggatacgagcgatttccggacgattttccgatcagcacaggcttttgaaacagcatggcttcaagaccgactgtcgaggtctgcgtcactgcggcatcagcatacggcagcaaatcataaagctccagctcctttttgatgactctgcatgctttatgttttttcgccgcctcgtgatacagatcaagcttgttttttccgatttcccacgggtggggtttgataatgatctgcagctgcttctgatcagaaagcccctgcagcacaccggaataaaagtcttctgaaaagggctgagtggcaatgagcacaatttttttagtcggctgaaaagcaagttttcgatagaatatggacatatccataggcgttctgttaaaaatctgatcgaagcggggatgtcccgttacgagaatctgctcgggtttacagccttttcgtatgaaccactctgcttcatacgcaccaaaaacagcttgataggttgtaaaaacaggaatgaaggcttcatctcccatcaatgcgccatgctgaagacaaatgctgacggccccttttctttgacacatgagagcgagcaccctgctgtaaatgtcttctgccgttccgacaataacagctgaaatcttttcctgttcaaacagcgcatcaactgtatcaatggcctctataaataaaggaatatctttgaaaagccggtcgcgaaacgcttgatcaccaaatgccgggtgatcatcataaggggcgagaagcgaacaggctgtttcgagatactgcttcgaatcgcctttttggcatgaatccgcaatctcccgcttgctaattacaggcagatcacaataatgcggcaaactccatctggccaaaacagccgttttttcaggatcaaattgatagtaatttccgtttgaaaaacgcaggtaatcaaagtgcaaaatgactttccctttaacaggtttgtcatttgttttaacgattttttggattctttcttcaaaaaacggctgaatctgtccctcatcgatatgctgatccaccgatccgaataattccggttcttcttccatcatcaccctcagctcagggctgatgtattgataaaaattactgataagcccaagcggaatccctttgtagcgaagtttgtcaaaaagctccacgtacttccggtacagcacccaataattgcttaaataggccgacaagctctcaccccattccaagcttttttaatgattcacgcagctctcggcaatttcgctgcggaggaaggttcctgacaaattcatttttttctgattcaaacagctgaaagtgaatcgattggtcggtaatataattcaggtccagctcctcatccagtgggtaaaacggataaaaatgattgactctccaaaagaaccgcgcatctcctatacggtaaaacgccgggctttcatcccaataggagccaaacttctcctttaccttctcaagcaccgaatacctgtgcatcaccgagcaatgatcaattgcgcacggtgcgttccatgtcacttgagcggcaggcctgacagtttcttttacaatgtcgcgattctcgtttaaatgataggttttggaggctgagtaaatcacagccttttcaggatgggtatcgagctcccgcaccattttcaggaggcggtccggcatatagatgttgtcatccgtcgcataggtgatatattcaccctccgccatctcaatcgcctgattgatcagtgccgcgtatctcgttttttctgttctttccttcactccagatatatcgctttgataaaaacgcactcggttatcattcaaaaaaggacggattacattcagcgtctcttcattggagttgtcatccataataaacaattcaaaatctgaaaatgtttgtgagagtatgctagaaatggactttgccacataatcgcttttgttatagctcgtcataatgactgatactttaggcaaatcctacacctccttcttggaacttcacacctgaaactatcgttatcttatgttgcttatgctcaagttgcgctagggatacaaaccaatatgcgaaaagtttgtgtatgtctctgaaaaacagcggctgcccagagcgaaatctgatcggtccgctgttctttttcagcataatccaagcatcagcctcataaggtgaaagagataaaaatcgcaccagcgactaagatcgttttccatcggaggtgagtcatcgcggagcgttcacctatacatccagaacatgttttgaatggttttcataaaaaggaggaacgatatgaaaccgaaaaaaaatcaatatcagcaaatgcaggcatttgataatatgcaggggtatcagcctcagtttggcgccaacccgtacccgcagcaaggccaaggctcacaaatgcagccaatggggatgcagccaatgatgccaatgcagcagggacagcaaggacaacaaggacagcagggatttggattcccgggccagcagcagggcggcggttttcaaattccatcggggcctacaccgtcaggaccgggccaaagcgttcccggcatgctgcctgttgaggaatcttacatcgagaatattttgcgcctgaatcggggaaaaacggccaccatttatatgacatttgaaaacagcaaggaatggggctcgaagatttttcgcggcgtcatcgaagctgcgggccgggatcacattattatcagcgacccgaaatcaggaacacgctacctgctcctgacaatctacctcgattacattacatttgatgaagaaattgcttatacgtatccatattccatggcgtcctattcgccaagataagaaaaaagccaatcactcatatgatgaggattggcttttttgattatagatatttgacggctgcgacaacgatcataatccaagaaataataaacgccacaccgccgagcggggtgatcgctccaagaatggagatttgcgtcacacttagaatatataagcttccggaaaacagcacaattcccgcaaacatcagccagccggctgtcgtgacactgcctatgccggataatttatcagccagaaacgcgacaacgaataacccaagggcgtgatacatatgatactgcacgcctgtgtgccaaacctgaagatatttatcaggtattttcccttctaatccgtgagcgccgaatgctccgagtcccacggcaagcagggcgttaatagcccctaatatgataaaaactttcatctatctctcccgccttttcgttaaactcatatcatttatcttatcgcacctgcaccaaaattcaatgtttgttctccgttgacacgagattgtcggattttctcctgcgccaaagctggaactggtcagctgctattgcagcaagcgtccctaatacgagcccgttgcttaatagagaaataaataccggatgcaatccctttaacgcagtttcaggaacaaacatgataccgacccctgtcagcagtgagatgccgatgatagacctcaccctttttgattcttctttctcatacgaatcaaattcggcaaaggccagaccgcccattgcggagaacacaacaaaattcaccgcaaatccaacgggtgacggcaggctcgcaaacgtattcataaaaaacgggatcacgctgattacgataaccagaatactgccgagtataaacggttttttagaaggcatcttggtcgtttcaataaaacctgcggctcccgaaatcggaacaggcgcaatagctcccgtcaaaccgctaagcagatggctgaatgaagctgcaaaaccggcatggcgttcatgatgctttccatcaggctgtttgctgaattttttcacggcgatgtccacgaccttcatgctcgccagcatattcacgatcagcaagatggtaataaaaatagaagtgatgatcaggccgctgttaaataacggtggcccaaaaggaaacagggaaggcagctgaaacagccggtccggcatttcaatcggctttgccgctccggcagccgcaaacagcacccacccgccgaacaaggctaataaaatagaatattgcttaaaaaacacgatgttcgaatttgtcattataaaggcggcagcgatcacaacaagcgccaggccaaatacaagaccgtccaccccgtcctgtcgataaccgattccgagaattccttttataatgggctgactcagctgcatgacaagaagcaataaatagacgcccgttacaaccggagtaaacaattttgcaagtctgtcaatgaccttgaaaacacttaacaaaaagaaacatacagcgcttacaagaagagctccctgcaacccccgcagtgtgtctccatatgtcgcaaacacagttcccgttagccctgcgtagatcgtatacactccccaccacaagccggctgggctttcattgatcggcagtctgtggcctttcaaacactgaatgacggcggcaatccccagtacaaaaaaagtgctttgaatcaatctcgcagaatctgagtgatccagatgaaacgactgggcaaccgccaccggaacaactatcgccgcagcaatgataaacgctgtccattgcaacgcgccaagaaccaatttcacgtaagctcaacctctctctttaaaaatcaaataaagactctccgtttccatcctcttcctgcttctctttttcttgctttcgatatttgtttaatcccgcgctccccatcattttttccatcatcagctggtctgtcgatggcggcgcggcaggacttggcgtaacgctcggctgtatgcggggcgcgctcgcgttctccggctgatcaagcacgacatcacacagagaacggacaaccgctacataacgcttcagctcctcatcccgttcagctgtttttgcttttttcagctcctcttccatcttttgaattaatgcagatatatgaatgttcatgaagcaccctccaaaaaaataaatgttgtcttcctgcattttatcaaattcctgctgtaaacgcagatatgagtttgttattttttctgacaaaccttgcgcgattgacaagcagaagagatttttcacataataaatcaccatacattacaaaaaggagaaacggaatgaacagcatcccctctatcatcagcaagcataaagcctattttgcggcgggacatacgagaccgcttgaatcgagactgaacattttgcgaaagctgaaacaagccgtcagaactcatgaagccgatctcatagccgctctctaccaggatctccacaaatccgagcaagaagcatactcaacagaaatcggaatcgtcttggaggaaatcagctttgtcatgaaacggctgaaaaaatggtccaagccgaaacgagtcaaaacgccgctgactcatctaggctccaaaagcatcatcattcctgagccgtatggaaccgttttggtgattgcaccttggaactatcccttgcagctggcgctttctccgttgattggagccattgcggcggggaacacggtcgttctcaagccatcagaatatacgccggctgtttctgctattctttccaaactcatcagcagcgtttttccgaccgattatgtcgctatggcagaaggcgggcccgatgtcagcacagcattattacagcagccctttgactacattttctttaccggcagcgtagccgtgggaaaagtcgtcatggaggccgccgccaaacaattaattcccgtaaccttggagctcggcggcaaaagcccctgcatcgtccataaagatgctgacattcagcttgccgccaaacgcatcgtcttcgggaaatttacaaatgcgggacaaacctgcatcgcaccggattatttatttgtccacgaggacatcaaaacgaagctcacagaagaaatgaaccgtgcgatcagagaattttacggccctcagccggaacggaatccgcagtacggcaaaatcgtcagtgaacggcactatcagcggctgctcagctttctgaatgacggcatcccactcacaggcggacaatctgatcccaatcatcacaaaattgcgccgaccattctcgaacaagtgagagatgactctccagtgatgcaggaggagattttcgggccgattcttccgctctttacataccgcaatatcggggaagtcattgagaaagtccaatcgcgccctaagccgctcgccctgtatctcttcaccacaaacaaagaaattgagcgcgctgttttaggaaatctgtcgtttggcgggggctgtgtcaatgatacgttaatgcatgttgcgacgccgtatttgccattcggcggcgtcggggaaagcggcatcggcagctatcacgggtttgacagttttaacacattcacgcacaaaaaaagcgtcgtcaaacaaacgaaccgtttcgacttcgcatttcgttatccttcctccaaaaacgggctgcgaatgattcgaaaaatactcaaataaaaaagcgcagataacctgcgctttttacaaatccttaatacaccaatcaatcggcgcctctcccattttctccaaataggcattcgcccgggaaaacggtctgctcccgaaaaatccgtttctcgcagaaaacgggctgggatgcgtcgattcaatgataaaatgcttggacgtgtcgatccgttcttttttcatttgggcatgccgtccccacaaaataaaaataaccggccgctccctttcattcagcacgtcgataatccggtctgtcagtcgctcccagcctttccccttatgggaattcgcctgtccgcgccttactgtcagcacagtattcagcaaaagaacgccttgctttgcccagctcactagcgatccgtgatttgggatgctgcacccgatgtcctgctgcagctcaagaaagatattttttaacgaaggcggctgctttacaccgggcttgacagagaagcttaaaccttgagcctgtcccggcccgtgatacggatcttgacccaaaatgacgaccttgacatcatcatatgatgtataatgcagcgcgttgaaaatatcccggctgtccggataaatcgtttgctccgcgtattccctcttcagcatctctctgagctcttgataatacggtttctcaaactcttcctttagctgattccaccagctgtcttgtaaaagctgtttcaagattcaggcctccttacgaacgatgaagtctggaatagacaggctcgccatcccaaaccatttcactttttgcttcccgcctcttcatctcaggctcttcaagcaggacggcaaagtttttcgtcggcagctccccgagtccgtgcttttcacttaaacgatccaaatattgcttccgcttggcgccaaggtccgcagactgattgtctcccacgtcactgaaggcataaatcacactggcgcaagggacacgcttcacccggtaatccttggctgcgcgcagataaaaatcccaatcccagtaattgtgcacatcagcatcgaaatacccgatttcatcatgcagaaaacgtctgtacatgctgcccgacggcacgtatgtagaaaacactctcatatcctcatagtcagcggtataagcaaacaatttccgtgacactggataccttgttccgtttttctcttcaaacgaaactatttccgcatcagaatgaacgaagtctgccgtttctatttcctttgccattttctcgatatgccctggcgtaaagaaatcatcgtcatcacacagcataatgcaatccccagacgcctcttttacaccggcatttctcgcagccacatgccccgagttcttttctaaattgatgacagcaatcggtagctccggatacagtgctttgaccggcacgaccgattccccggcatcattcacaataataatttcatacggcttcaaggtctggcgggaaatcgactccaaaagctcacacaaagccggaatccgattataggtcacaattacgatagaaatcttcatgatgctctccttctcattttcatagtcatgtactattaaaacatatattggacgggagatcagtgggaatatcctactgaaacggcatactacaatgatagaaacagcaaagtggctccgatcagaagcaccatgatcagcatcagatctccaaagacatgaaagaaatctttcatgcggacgccattcggaaggataagacgccacagcttagattgatagaccggcagcagcaccagtgcataagaaagacacaaaaatgtaaaagccggcggcacaaaagcacagcctgcatcgtcccaattcatcatgatgtctttcatactagatccatccaataaaaacaaagatatcatgagggctagcaacacaaaggaccccaattgaacctcaaacaggcgcattttctggttatatgcaaatcggaccgcccaaaaccagacataagcatatgaacatagcagcgtaagaatggcacctgctgtaaagacgacatcaggcagccgatcaagcagaaaaacaaaaggcaagctggctgccatagccaagagcatgcagccaccagtaaacaaaaatactgccccatgagctacaaaaccatataaacaagagctaatcctcacgacatacacctcctttacatagaaattctatgtatatacctaaaaaatcagacaagctgacgcctgccaatataacagcccattcggccaaataacggaaataacagcgttgcaaaagcacaagttccaacaaaccaaggtgtcaacaaggattgaaacagcgcagcaggaattacattgaatagaaaaacaagcataaaaatgacgtttggcaccattgagatcagaatcgtatgtagaacaagcttttctccgcgttttccaaactccttcacgccttgatacccaatcagcacccagtagatcatatatgcagctaagatcagccaaacagaaacagaaatgcctttccatactgcttgaacaaacggtgattcaagccatacatgcattattgtaatcgcaatgccgacagcgaatagggcactgttacagaaaagatggaacatcaaaaacgcacggaacgttactggctgtattttcttaaacgaagaaacaatgtcagttggtgttccaaacgcctgcaataaagtctgcatagcttcctcctcactctttccttcctgaaaagagcgaaacagatgatgttcaatatggctctcaatctcttctatcatcgcctcaccctcaggaagccctttaagcccgcttttgatttcggatacatatgtttctttatccattttgtccgctccacttcagtattcggtccatcatggctgaaaatacgctccattccttcgtgcgttccgccagcacttctttgccctcgtctgtaatccggtaatatttgcggtccggtcctttctcctgcttctcccagtaggaagaaatatacccttggcgttcaagcttgtgaagagaaggatacaaggtcccttctttcatctgcagttcatttccgctgcggcttcccatttcttttacaagctcatagccgtacatcggccgctcgttcagaagcgtcaataccaatataaccgtgcttcccttaaccagctcacgatttaacatctcaaaacccctacctagttttcttatgtagcattttacgaaagcccgttgagattgtcaaatgattcctatagatcttctatattgtgatacagagaaaatctaactataatgaaagacaaaacacgatggaggttcaagacatgtctatgcataaagcactcaccattgccggctcagattcaagcggcggtgctgggattcaagctgatttaaaaacatttcaagaaaaaaacgtatacgggatgaccgccttaacggtgatcgttgcgatggacccaaacaacagctgggaccatcaggtattcccgatcgatactgatacaatccgcgcccagcttgcaacaattacggacggcatcggcgtggacgccatgaaaacaggaatgctgccaaccgttgacattatcgagcttgcggcaaaaacgatcaaagaaaaacaattaaaaaatgtggtaattgaccctgttatggtttgcaaaggtgctaatgaagtcctttatccggagcacgcccaagccctgcgtgagcaattggctccgctagccactgtcattacgccaaacttgtttgaagccagccagctcagcggcatggatgaactaaaaacagttgacgatatgatcgaagccgcgaaaaaaattcacgcactcggcgctcaatatgtcgtcattacaggcggaggcaaactcaaacatgagaaagccgttgatgttctctatgacggagaaacagcggaagtccttgaaagcgaaatgatcgatacgccttatacacatggcgcaggctgtacgttctcagcagccgtgacagcggagcttgccaaaggtgcggaagtcaaagaagccatttacgcagcgaaagaattcatcacagcggccattaaagaatccttcccgctaaaccagtatgttggtcctacgaagcattctgcactgcgcctgaatcaacaatcataaacaaaaggggctgcctaacaaagaggcagccctttttaaatcaccgaagacttttcacagaaaaaactgccgatcccatcggcagcctgtttatttgatttttaaattgtttgcagatttcctcaaaaatgtttctatcgactgaacaaaaagtgcatattccttcatttgttcatatgcccgcgtgagaatttccgccgtttcactgtgcggcgttgttccgccaagcatttttttcagctgaagcagcacatccttatattcttcccgcttatcttcaacttggttagcagccttttccaaacattccggtgttatcttctgttcatttatattcaagaaaacaactccttttacagaaaaaaatagtaggttatcgttgaagaatagcacagatggctcagatttcacataagaaaatagaaggattttctacataagtgtccaaattctgacattcatttcagatttcccggtcgaactggctgttacttcatgatttcccgggaaaggaaaatatctcgcactaaagacctcttctccgttattgataaagatttcaacagaggatgcgtcgataaacatgtgcacggtatgcaaatccttgatgcggcaatgtctcgcttctgttctttttccgtcaaagccctttcgttccagcgtaacattccccttgtctttatggaaggaaaacgtagccgttccgcggatactgattgaaaagcctgactctgtatgaatgtcttccagcagaatctcagttctttcaggtttttccactggaagcgtaccagatgatccatgcatgttgatgtgtatttttttctcatttctgcgcatggcttttagctcaggcagcggctgctgaatcagcttctcgcctgatattgtcagctgtctcggcagcgtcatgcagtgaatccagtgatagtcaatcgtcggatgagatccttcatcctggtcaggcacagccatccatgcaaacaaaattcgtctgccctgatcatcttcaagtgtttgcggcgcgtaaaaatcaaaaccttgatcaagttccctaaaatcaccatgcttcagttcaggcttgttataatcgagacgcccgacaaaataacctgactgatatacgttctgataaaggaaaccgtcagcctcaagcccttgaggcgaaacaatcagcacgtccgatccttgaagggaaaacaaatcagggcattcccacatgtatccaaaatcgtccagcccgttgaagcccgcgccggttatcgggccaagaaatctccactcactcaggttatcagaagcaaacaatacagcctgccctttcaaattctctgtttgcgcaccaatcaccatataccatgtgccttcatgctcccataccttcggatcgcgaaaatgcgccgtatatccttccggaaggcgggcgacaacaccctttttctcaaaggacagcccgtcgtcagaaacagcaaggcattgatacgtttcccgatttccatcctgatccctgacatttcctgtgtaaaacagatagagccgatcgtctttcgtgacagcgctgcccgagtagcagccgtttttatcaaaccaatcactcggagccagcgcaatctcttcccgcttccaattcacaacatcctgtgtcgtataatgcccccaaaattttgcgccgtgccccgtctgaaacggctgccactgaaagaatacatgatagctgcccttccaataaatcacgccattcgggtcattcagcagcccaaccggcggcatgatatgaaaatgctggcggtgcggatcgctgttagcgatgggctcttttttctccacttcttcataagcccggcgacgaagctcctggtcatgtgctgtcattttttcctctcctcatcctcattaatcttcatgacaaatgctgcaatgaacgctgacactgctgcaatcgccatgccaatcagatagtgaatcaagttgctgacgccaaacggagccgcaatggcgatcatcggaattcccgttaacccgtaagcgtttgcagctacatgtgtaaagacgacatatgccccacccaatgcgcctccgatcatcgcggcgataaacggttttcggtagcgaagattgactccgaatatgacgggctcagtaatgccgagaaaagcggaaaatgctgccggaagcgcgatttcttttgtctttgcctttttcgccataaagaagacggcaaggcctgccccgccctgtgcgacattcgccattgaccagataggcagcaagtagtttttgcctatatctgcaattaaccccgcctcaatcgcatggaagctgtgatgaacacctgtcagcacgatgagtgaatacgtgcccccgaaaatcaaacctgcaacaaaaccggcatggtcatacacataagttaaagcaaccgtaatcccggagccaagggctcttcccagagggccaatcgcgataaaagcaacaaacccggtgacaattacagtaacaaaaggtgtaacaagcaagtctaccgcatgcggaaccacttttcttgtccatttctctaccttgctcattacataaaccgccagcagaacagggatgacagttccctgatagcctagaagcgcgatatcaaatccgaaaagatgcatataatcaggtgtggcttccgccaatccccatggatttaaaagagacggatgaatcatgattcccccgatgaccgctcccaagtatggattgctgccaaactcttttgaagcgctgaccccgattagaatcggcaagaaaatgaatgctgcacttgaaaacatatcaagcagctgcaaaagcgcagaatccttgctcatccaatgaaacgcattgatcatacccagcaatcccattaataggccgctggctacaatagccgggatgattggaacaaaaatattagaaagcgttttcgcaaatctcgcagcgggattcagcttttcttttgccgcatcctgatgatttacgtgttcttcacgctcgatatcagcttctttagaaaaggcatcgaatactttattcacaaggcctgttccgaaaatgatctggtactggccagagctgctgaaagcccctttgacgccatcaagctcttctacttgtgcttgatctatctttgattcatctttcatcactaaacgcagtcttgttgcacaatgagccgcgctgataatattttctttccctccgagaagctcaatgaggcgttttgcagtctctttgtaatccatctatttctcccccttttatttaaacaaaaaagacctaaaattcgccaacgaataaaggacacagcgatcctttttcatttacgcaaattttaggtcttgcctgctttaccagtcacaatcccgcttattcagattaagaatacgctttcatcataaatcatgacagcgttttcgtcaactatttttttagttaaatagtttgataaaacatgtagacaaaaattcgtaaaaattaattgtgaaatacttcacaatatcgtgctatactatgctcaatcatgaaagaaagcaggaaaagacaatggaaactcaagcattgcaaaaggttgaacagtatgctttgaaaaaacaaaacatattcgcttcaagcaaaatccgttatgtgcttcggtccattttggccagtatgtttattggttttggcattacagccgcaagcaaaacaggcagctatttctttatggctgattctccgtttgcctttccggcagccgctgtcactttcggggccgctattctgctgattgcttacggaggcggagatttatttaccggcaacaccttttatttcacctataccgcgctccggaaaaaactcagctggcgcaacaccctgtacttgtggatgtcaagctatgccggcaatttaatcggcgccattctgtttgccatcctgatcagcgcgacgggactttttgaggagccttctgttcattcctttttgattcatttggcagagcacaaaatggagccgccggcttccgaattgtttttcagaggaatgctgtgcaattggcttgtgtgcctcgcctttttcattccaatgtctctcaaaggggaaggagcaaagctttttaccatgatgcttttcgttttctgcttctttatttccggctttgaacacagcattgccaatatgtgcacattcgccatctcgcttttgatcgagcaccctgatacagtgacactgatgggagcagtcagaaacttaatccccgttacgctcggcaatctgaccgcgggaatagttatgatgggctggatgtactacacactgaatcctgatcaataaaaaaacttccagagatcactccctgcaagtcaaagcggttattccgagagatcttgaagacgctggacatgcagcgtgatatagccggcctcggattccggcaaatgtaattgatattcatttttcaaaaactccgccagctccagcgcacattgataggcgaatgaatactttttttggatgaaataaagcatctcctcgtccatacgatggagcgcttcatttgattccaaccggctgaccgcgtatcgcaaatgcgtgacaaggcgttgataggaaatgctgttttcatccacctttcgattaaagtattgttctattttctctatcatttctttgatcatggtcgtatgcttcagcgctgaatacatgctctccgcatccatcttcgccgtatggatgtgaagggcaatataacccgcttcatcttcaggcagagacacgcccaatgtctcttttacatgtccgatcgcccacaggccgatctcgtattcttttttatagagcgcctttatctcatgcagcaatttattctgcacaagcaacccattttgaatcctttcgatcgcaaaggacaaatggtcggaaagcgcgatatgaatgtgatcgctcagcggcgccgcgagctctccttccgcatagctgatgatatcctcagctatttctacatgctcctccggcagtgtttgcaggatttgtttgaacttttcattctcgtcgcgcacgacaaagattttttccactttattcatagggatgagatcatttttctttttttgaaaagcgattcccggccccatcacgattttttcctgatcatcctcttttattaaagccgcattgttgtttaatactttatagattttcaagaggttatctctcccgccaatttgcttttgactgggattttacctccttttgaccgccatgtaaagatgcgggcccgctctctcctgctttggcgattccttgaaggcttgcaaacatcttcttttataaagcgcggcggctttcgctttctgcttttcttcctcattcacagccatccgccactcataaaacgaaacgagtcctgcggcctgcacagccgcctttctttggtatgtacgctgagccgaatagaccgcggcagccgcagtttttctgtccggcgtcacccagttcatcaaaaagaccatccacacccgtaaagatacaagcaaacgtttcatagaaaaacatccctccgcttctttttggcaggcagcctttttagcagcccgttttctcagccgcagcccgcaagaaaagacggccgatttcttttctcgcaaactagcggctctagcaaaactcatgactctatgatagaccgtggaaagagaattctttgtcacaatatgagtgaaaaaaccaactagtttttagaagttttgttgaaagctgaaagaattgaaatgaaaattggagaaccgctttgaaaactttatacacaagttatcccaaagataagaacaacttaatcacaagagatatccacatgtccacaaactctatctatattttgtatacgaacgtatattcctaactatatatatacacaggtttattcacttatacacagggttctgtgtataactccttcgttatacacaaacaaactccaataaatggtccaaatgacacaaggatttttttgaattttcaagaaatatatactagatctttcacattttttctaaatacaaagggggaaacacattgaaaaaggggatcattcgctttctgcttgtaagtttcgtcttattttttgcgttatccacaggtattacgggcgtccaggcagctccggcttcttcaaaaacgtcggctgatctggaaaaagccgaggtattcggtgatatcgacatgacgacaagcaaaaaaacaaccgttatagtggaattaaaagaaaaatccttggcagaagcgaaggaagcgggagaaagccaatcgaaaagcaagctgaaaaccgctcgcaccaaagcaaaaaataaagcaatcaaagcggtgaaaaacggaaaagtaaaccgggaatatgagcaggtattctcaggcttctctatgaagcttccagctaatgagattccaaaacttctcgcggtaaaagacgttaaggcggtgtacccgaacgtcacatataaaacagacaatatgaaggataaagacgtcacaatctccgaagacgccgtatctccgcaaatggatgacagtgcgccttatatcggagcaaacgatgcatgggatttaggctacacaggaaaaggcattaaggtggcgattattgacactggggttgaatacaatcacccagatctgaagaaaaactttggacaatataaaggatacgattttgtggacaatgattacgatccaaaagaaacaccaaccggcgatccgaggggcgaggcaactgaccatggcacacacgtagccggaactgtggctgcaaacggaacaattaaaggcgtagcgcctgatgccacacttcttgcttatcgtgtgttagggcctggcggaagcggcacaacggaaaacgtcatcgcgggcgtggaacgtgcagtgcaggacggggcagatgtgatgaacctgtctctcggaaactctttaaacaacccggactgggcgacaagcacagcgcttgactgggccatgtcagaaggcgttgtcgctgttacctcaaacggcaacagcggaccgaacggctggacagtcggatcgccgggcacatcaagagaagcgatttctgtcggtgcgactcagctgccgctcaatgaatacgccgtcactttcggctcctattcttcagcaaaagtgatgggctataacaaagaggacgacgtcaaagcgctcaataacaaagaagttgagcttgtcgaagcgggaatcggcgaagaaaaggattttcaagggaaagacctgacaggcaaagtcgccgttgtcaaacgaggtagcattgcatttgtggataaagcggataacgctaaaaaagccggtgcaatcggcatggttgtgtataacaacctctctggagaaattgaagccaatgtgccaggcatgtctgtcccaacgattaagctttcattagaagacggcgaaaaactcgtcagcgccctgaaagctggtgagacaaaaacaacattcaagttgacggtctcaaaagcgctcggtgaacaagtggctgatttctcatcacgcggccctgttatggatacgtggatgattaagcctgatatttccgcgccaggggtcaatatcgtgagcacgatcccaacacacgatcctgaccatccatacggctacggatcaaaacaaggaacaagcatggcatcgcctcatattgccggagcggttgccgttattaaacaagccaagccaaagtggagcgttgaacagattaaaaccgccatcatgaataccgctgtcactttaaaggatagcgatggggaagtatatccgcataacgctcaaggcgcaggcagcgcaagaatcatgaacgcaatcaaagcagattcgctcgtctcacctggaagctattcatacggcacgttcttgaaggaaaacggaaacgaaacgaaaaaagaaacgtttacgattgaaaatcaatcttccattagaaaatcatacacactggaatactcatttaatggcagcggcatctccacatccggcacaagccgtgttgtgattccggcacatcaaaccgggaaagccactgcaaaagtaaaggtcaatacgaagaaaacaaaagctggcacctatgaaggaacggttatcgtcagagaaggcggaaaaacggtcgctaaggtacctacattgctgattgtgaaagagcccgattatccgagagtcacatctgtctctgtcagcgaagggtctgtacaaggtacctatcaaattgaaacctaccttcctgcgggagcggaagagctagcgttcctcgtctatgacagcaaccttgatttcgcaggccaagccggcatttataaaaaccaagataaaggttaccagtactttgactgggacggcacgattaatggcggaaccaaacttccggccggagagtattacttgctcgcatatgccggaaacaaaggcaagtcaagccaggttttgaccgaagaacctttcactgttgaataagaaaaagccctgccgaatcggcagggctttttaaagatcagtcagcaaacgcctcctgcaataatcgatacgatcggagcttatcttcaaaatgatgtgtgatggtcaccaccatgatttcctctgtttcatacgctttactcaaagctagcagccgctccttaacctgttctttcgtaccgacaatcattcgatttcgattatcagcaattcgtctctgttcataaggagaatacgtatttttccgaacagcttcatacgaaggaactccctctaaaggaataccctgctctcccgccaaaagtgtaaaatcaagcacagccccaagctcctctgccttctcctccgtgtcagcacaaagaacaaaaacagcaactgccgctcgaggcgtatctcctaacacagacggtttgaatcgtctcttatactgtctgacagtaccctctccgccctctccattgataaaatgggcaaacatatagccagcgccagattcagctgcgagcagcgcgctttctccagatgagccgagcagccacacatccggagccgttgaaatatgcggcgcagccgtcagattcggaaaacggtgtttatcatccgccaaatcatgcaaatacatggtcagctccttgatttgctgcgtatactgatcagcattgcgcttaccgccgtcattcagcgcccatgatgcaatcggcattccccccggtgctctgccaagccccaggtcaattcttcctggtgtcagcccctccagaacacgaaagttttcagctactttataagcactgtaatgcggcagcatgactcctcctgatccaacacggattcgctttgttttcgccgctatatgactgattagcacctcaggactggaccctgccagccgttttgaaaagtgatgctcagaaacccaaaatctcttatatccaaggtcctcagcagcttgggcaagcgcaacggtttgctgtaaggccgtttctgcattgctgccctctgatactggagattgatctaatatacttaatgaaaccatccctaccacctcatcctcatcgtatcactgatcttctactttttctccaaagccgctcacattgcttatcagtgtcccctatcattcgccatttatttgtgaaagcctgtccctatttgtcggaatatgttacacgtgaaacataaaaacccctccagacggagaggtttgctttagtttttattaaagcccttttctttcacgtagtcatttaaatacgtacgcggcttttgcttcataaagttcagtatttgatcggaccacgtttcttcccgctgcccgtttgttctttctctatagtaatcagaaatggttttgtcatacgtattcatagtatgacggaaatcgtctgtgttcacattatacgtattctcatgataaacggcctgctttggcaatctcggttttttgccggaaaggttcgcaggatggcctactgccagtccgaaaagcgggagcacatggtcaggcgtttgcagcacctctgtcaccttgtccagttcattccgaatgccgccgatatagcaaatgccaagccccatggattcagcggcaatgctcatattttgcgctgccagcgccgcatcaatcaagctaaccataaacatttctgtattctcgagcagctcagaaatatgttcacctttttcctcagccagtttttgatggcggtacaaatccgcacaaaatacaaaaaagtgtccgttcttctcaacgtaaggctgattcccagcaagcacggacagctcacgttttttctcaggatcagaaaccccgataatcgaatatgcctgcacatagctggatgtagacgcagcctgcgcacttttcactaatgtatcaatttcttcagctgtcaaaagctgatcagtaaaagaccggattgaccgatgattcaaaatggtttcgattgtgttattcatcacaaaaacctccttatcactttttatcatatccgaaaaaaagtgatctcaaaagcgaaatgctctgcacaaaaaaagacagcctctgtaaaggctgtctgcatattaagaattaaaaagataacttctgtatttcgtcagctgcacacttgcattatatacaatcccaaatccgattaacgtggaaagtgtcgagcttcccccatagctgacaaacagcaacggaatcccggtaacaggcataatgccgatgttcattccgatattctggaatgtgtggatcacaattaacgccgtatagccaacgcaaaagaaagaagcgaaacggttaaacggatgtattttgtctatcagaacaacaagcctgtagattaaaaagaagaacatgatgacaacaattgcacagcctataaagccaaatgactcacctattatagaaaagataaagtcagtcgtactctctggaacataaaccttcaaattagaaataccattacctaaaataccaccagatcctattgccatgatggcctggtcaacttgccagctgtcatttgaatcttcctgtgtctcatttgaagcagacacccaagaagtgacccgcttaatttgataatcctgtattccaactgatttagcaacgtcaggaaagtttatcattactaataaaattaatgaaatgagtaagatacctgaaccagctatgatcgcaatcaatttccaatttatacctgacataaaaaccattacaagaacgataaacatacatattcccgcagtcccagcatcctgcatcaagataagacctacaggaataactgcgacacccgcaatctttaataacaagtggatatcatccctaagcgtccgaactcctttaggattagcttttccaataactgaagcaagcatcataatcaaaccaaccttcataaactctgacggctgtattgttattctaccgatcctaaaccaactttttgcccctttaataacaggtgcaatagactcgggactgattttaagaataatcaaagataaaataccaatgataaaaatatataaacttaacttttcaagctgttctaaatcaaagtacaaaagaactgtaatggcaacagcccccaaaaaataaaacacaatttgctgaatccaatccgtgttcccatactgcccaaactgaccggcagcataaattgatactacgcttataataaaaaacacaccaaatataaaaatcaaatccccctggtaaaaggggctttgctgtttcttatatcgactcattctatcccgccttacattttcatcggaaaatcactaatgtttattatacatgaaccacgttcaagatgacacgtgaagctcgcttccttttatgttttttcagcatttgcggcgctttttcagctacacgaaatatgacgtatcataaaccgaaatgtttcgattgacacaaaacttttcaaatgaaaaaaacgccataccaaaagaatttgttaaaaaacgaatgcgataatgtgttatattcccaaataatgtgatacctcataagaaacagctaaaaattcagagccccatgcccatacattctcctagcacattaaacgaaaaaataagacgatagatccagtccatttctgcaaaaacacgtatcaatttctggaaaacatggtataataattgtaacagaatattcaaaaaacaatcacaaaacagacacaactcagttcctctatttcatttttgtaaacgttatcacaaaatgaaaggagacgggtatgatggacatgttttttgcttacttattggttgccagcgcaacgcctctctttatttggcttgataacaaaaaagtcgcactctcagctattccgccaatcattttaatgtgggtattcttcttcttttacgcaacagaaagcctttctccacttggacacactctcatgattatcttgtttgccgttaacgtcattgtcgctcatatcgccgcatttatcatttacggccttccgtatcttcgcagaaagcgaagcagctgaagacagcaaaaaaccctcttccaatgaagagggtttttgtattattcgttatggcctgaatgctctgagtgttcagcgcctccaggaggatttccgtccatatggtcaccatggtgatagtgagccgcgaaaatccagatggatccaagtacgataacgatcgcgccaaagaatccgaacagcgtgtttccgacttggatcgtgccgttttcgctctctgtcatatgcatgaacatgagaagctgcagcgccgcctgaatgaaggcgaagccgaagataatccaaagttttgctgatgagctcaggtcagtatacactgcaacccatagagccagcagggtcaaaacgatagacaggataaaacctacaatgtgtttccatggaaagtgactgtgttcagcagatttgtttgccattttacagacccccaatcccatgagatagacacctgtaaagatgaaaatccatacaacatctaagaagtgccagtacaagcttgagataaagattttagatgaagtttgcggagttaagccgcgtttcttcaactgaatcagaattcctgtgatccagaaaatcccgattgttacgtgagttccgtgagttccaagtaaaacaaagaatccagaccagaacgcacttgtactgagagccgctccttcatgtacatagtgaacaaactcgttgatctcgcatccgacgaagccggcaccgagaagaagagtgataattgtccaaatgactacgccttttaaacttccgcggcgcatttcatgaacagcgatcccgcaggtaaagctgctgatcagcagcaagaacgtcataatcattaccagattgacttcaaatagttcgtctggcaagacacctccagctgttctgtttttaagaacgaagaaggttgcaaatagtgttgagaacaacacaatttctgcccctaaaaagatccaaaacccgagaatattaagtctgccggtttcagattgatattccataggcgcgttagaattgccgtgttctgcatgttccataactcacgcctccttattcggaaatctttctttccgtctcttttatttcatcaacactaatgtagtagccgttgtcgtattcgaatgaacgcagaaccatgcagagcaggactccgatcaatccgactacgcccatccagtaccattcaaagacaagtccaaagcctgcaagaccgaaggcaacagacataaagaacggtctgcctgagttgcttggcatatggattttcttgaatttgctttcagggtataattcagttttttcttctttcatatgcaggaatgcatcttgagatttgacttcaggaagcaccgcaaagttgtaatgcggcggaatcgcagaagaagtcgcccaatcaagcgtacgtcccacaccccatgaatctccgctgatttcacgagtagagtaacggaagctgtagtagatgttatagcaaaggattaagaatcctacacccatcatgaaagctccgactgttgagataaagttcaatgttgtccagccgtcattcggtccgtatgtgtaaatacggcgaggcatgccttgaagccccaagaaatattgcgggaagaaacaaatattgaacccgatcataaagatccagaagaaccattttccgattctttcgttcagcttgtggccgaacatttttggataccagaaaataaatccggcgaaacaagcaaatacagtacccgcgatcagcacatagtggaagtgagatacaaggaagtacgtattatggtattgataatccgctgctgccatcgcaagcataacccctgtaaccccgccgataacgaagttaggaatgaacgcaagcgcccacagcataggtgttgtaaagctgattcggcctttatacattgtaaagagccagttaaagattttaaccccggttgggattgagattgccattgtcgtaattgagaagaatgagttaacggacgcactgttccccattgtgaagaagtggtgagtccaaactaagaaactcaatacagagatggcgataatagaaccaaccatcgctttgtaaccaaacaattgttttcttgcaaagcttgagatgatttctgagaaaataccaaacgccggaagaataacgatatatacttcaggatgtccccaaatccagaacaagttagcccaaagcatcggcataccgcctgcttccaatgtgaaaaagtgagcgccgaacaaacgatcaaatgataaaagtgctaatgctactgtaagtacagggaaagcaaacacgataataaccattgtgatcagtgttgtccatgtgaacattggcatacgcattaatgtcatgccttttgttctcatttttaagattgttaccataaagttgatccctgtcatcagggtaccgataccggcaatctgaagtccgaggaggtagtagttctcacccggcccagggctcatgtcgttacttgcaagcggcatataactcgtccagcctgcgttcggagaacctccgataacgaaagaaatattgaaaagcatcgcccctacaaagaacgtccagaagctcaggttgttcaagtaagggaacgcaacgtcgcgggcaccgatttgaagaggcacaacaacgttaataagaccgattaagaacggcatcgccatgaagatgatcatgattgtaccgtgagttgtaaaaatttcattatagtggtttgagtctaaaaaactgttattcggaagcgctagctgggcacgcatcatcagaccgtcgacaccgccgcggaataacataattacagcagatataatgtacatgattccgagttttttatggtcaacagtagttatccattcagaccacagccatttccactttttgaagtaagtcagtacaaaaataatggcaatggttgaaagcgcaatggaaacttgtgcgcccagaattaatgggtcaccagttacgaaaaattcgtcccatttgaatttcatgcaggcttcctcctttcctgatcaatatcattcttctgtatcatcagacttcttaaattcgtttttctttacgttttcaaacggatctgttttagagtgcggtgaaacggcttgatagccaaggcgtttgcgcgcctccatcgcgtactcagcgtcttgtccgtgatcaacgtatttcaagtgagtagaagagaacgttaattcgtccacattttcaggaagcatcaattcatcatacttctcttttgtcagcttaggagcctcgttctgagtctttttcacccagctgttaaagtctttttctgtaactgcattcacatcaaactcttggtctgcaaaatgttcacctgtgaagttcgcgttgcggccttcgtaagtacccactttgtcagcctgtaagtattgatccatcagcattcctgccatcgcatatttttgccctccaagctgaggaatccatagcgaagccattgaatctgcagatgagattttgaacaagatcgggcggtcgacaggaatgtttaagtagttgaccgtttcaatatcctgttcagggtagctgaatacccatttccagtctaccgaagtagcataaacaacaagaggctctttatcttttgttgcttcaggagctttttctaacgaatatatcgtctgtactgttggcacagaaagtgcaatgacgattaaaattgggatcactgtccagactacttctaaaaacgtgttaccgtgaatttctgggttataagatccattatctttgcctttacggtcgcggtattttactaaaataatggtaaatagaacaaagacgaccccgacgataaacagcataaatccgatagataacaggattaaatcactttgctgttcagctacaggtcctttcggatctagtactgaagcattgctgcatcccccaaggacgaaaaccacagttaacagcgctaatacaagcaacggttttaatgctctgaacaagaagatcaccatccttcctattgatgtaataaatctgaagtgcatacttcctcaaaatcttttctctactttgttatgctatcaaaaacttcacttattagctttatttttttataaacttcatcccattttcgcttaaatgtcataaaatcgacaaaaattgctccaactttattcacatctatcgcttaagatgaaaagtttctagttatttccgcatataagtaaagaaaagatgatgaagaactaattctgacaaataaaggtttaccacaataaaaaacttaggtcaatcaaaaatttcattttgttaaactttctagataggaattattttttccttgtctagcatcttttcacacggttaccattttaacgcatcaaatattgaaagaaaaggcgcaatgaagagccaatatgctctgaattgtccgtattttttaatgagagcatccagttgtttatcttatacaaaaaagaggaatgatataagcaaataaataaaaaataggatgtgttgcatgatgagttttcttatttcacttatcgtcgctattattatcggatggcttggaagcctgtttgtaaaaggagatatgcccggaggaattatcgggtctatgatcgcaggtcttattggcgcctggatcggacacgggctgcttggaacatgggggccgcacctagccggatttgccattattccagcggtaatcggtgcagccattgttgtctttctagtaagcctgttaaccagaaaaagaggataaaagcagcagcacccgaagcgtcagcgctttgggtgtttgttttgccataaaaatcgaaaaagcctcaaccctagcggttgaggcttttgactggtttggcgcccaactggtcgataaaccttctgaaggcctgttttccttctgttgtctgtttaaacacaccggcgtgttcaaggatgcgcgcgaatacatgtcccagctcttcttttatgactagatctgcattctcttttgttatggttcttttttccatcatccgattagcccactcactatgttttgccgtgagcggattttgttctaaagctgttttcggatcagcagagcatagcgccgctgccgtttctttcatttcctcctgtaagcggcccggcaatatcgccaatcccatgacctcaatcaggccgatattttcttttttaatatggtgaacttccttatggggatgaaatatccctaatggatgctcctcatccgtccggttgttcctcagtacgatatcgagttcatacaagcctcccctgcgccgtgcaatcggtgtgaccgtattatggggcgtatcgcctgtataggcggcaatgccggctttttcatcggaatacgtctgccacgtgcggaagatatggtcagcagcttcggcgacatgacccggttcgtctccttggagcctgagcacagacatcggccacttcactaagcccagcgacacgccgggataatcgtttaattcataaacgtcttccgcttctgcacgtgccattggaaaatcatgcgcgccgccttggaaatgatcatggcttaggatgctgccgccgacaatcggcagatccgcgtttgaaccgataaaataatgcggatattggccaagaaatgacagcagcctttcaaatgtttttttgctgatctccatcggttcatgttcaccttttaagacaatgcagtgctccggataatagacatatggcgagaattgcaggaaccattgttcgtcctcaaggatgaccggaatgattctgtgattttgccgggctggatgattcacgcttccctcgaagccgacattttctttacacagcaaacacatcggataatttgtctgttcctgctcttttgcagccgcaatcgctttcgggtccttttcaggctttgataggttaatggtcatttccagctcgccatattcggtcggcaccgtccaatgaacatttttggcgattctgtcagtccgtatataatagacatcctctgaatattgatagaattcctttgtcgcctgttttgggccgtataatgcttttgtctcttcaaatttgcgaatgacctcggacggggcaggcacaaaacagcccatcagctttgcgctgagcaggtcacggtacgtatctgtatccgcttccattcggccggtttcggcagcccatttatagatgggagctagcaagtccggcaggctttgtgactgcttgatgctggtgctggagttcggctcgggatgtgtgatgcccagcgcttcataaagacggtttctcgtatattcccgatcccagatcgaaatcaattttcgttccaggccatactcaagcagctgttccagatgttcaataatactcatatgtcactccccctttagttctctcgctccctctccgatatccgcgacataaaagtccgctcggagccctgttttttcttgatatctgtctccaaccttctgaataaaatcatcaacgaactcatcttttacaatgctgatggtgcagccgccaaagcctgctcccgtcattcttgatcctattacaccttcgtgatcccatgccgcaaacacaagctcatcaagttcagggcatgttacttcatagtcatccttcaatgagaggtgggattccttcattaactgcccaatttcatctatattgttctctttgaacatatgggccgtcttaatagcacgatgattttcgtatacagcgtgctttgcccggcgtctgttcgtttcattttggatcaggctggaatgcgcatcgaaatcagaaggcttgatgtcgcccagtgcggcaatatcgaggccttttttcagatcaagcaatgcatcattgcattcttggcgtctcgtattatagctcgagtcagccaatgtcctttttttgttcgtgttcgcgatgaccagcgcgaggcctgagacattgagtttgctatattcatagtcaagcgtgtcacagttcagcagcatcgcatgatgttttttccccattccaattgcaaattggtccataattccgcaattgacgccgataaaatcgttttccgcatgctgcgccattttcacaagctcaagcgcatctacttcaggatgaaaatagctttggagcacgacccccatcagcagttcaatagaagcggaagacgacagccccgccccgtttggaatattccctgaaaatacaatgtcaaagccatagggaactgcatatcccctctgttgaaattcataaatcacgccttttgggtagttcgcccagtcgtcttctttttgatagcgaatgtcgtcaaggctgcattccttgatcccctcgtctttaaagttgtctgaatacatccgaacaagcccgtcttttctttctgcaacagcagcatatgtacccattgtcagcgcgcacggaaagacatgcccgccgttatagtctgtatgttctccaatcagattcactcttccaggtgcgaaaaaaaaccgtaatccctctttttctccgaatacacttgcaaatatcccctttagctcttcccgcatgtgcaatcacctttctggtttttattttttattccccttatttctccatagaaaacggcagatcatatgctgcagtcctctcataccccttcttcttttgtttttttaaagacgagccatttgctcgcaacatagttgacgacaacaatgaccgcgttgtcgagtattttggccaaggtttcatttgtattgaactggccgacaagaatgatcatcatgcctaaatctatgccgagagacaggacccgaacgctgaaaaaagcagtgagctctttcagcaggctctgcagatcatgtgttttttgctgaaacacatataatttatttgttatgtaagcaaacagcacggacaaaatccaagcggcgacagtggcggctttgtaatccacattcatgatctctaccaatatataaaagctggcgatattcacaatggttgtgaaaacccccataatgatatacataattatttctctatacttcactgatgttcctcgctttctgaaaaacttttcaaaattcttggcctctcgtgctctctgtctaaagtaaaaaataccgaaagtgcgtctaaaaagctgcggaaggtggctggctggcccaatacatatgattgtttgatgattccgtcgaggactgcacatattattttagccgtatattcaggatcaatacaggcgtcaatcagctttctctccttcagccacttaatatataacacattttcttccacccacaattcgtacagccggacataggccttgcatttctttaagactttatatgtcggcatgttcatggcaaacgaggtgatgtcccacgacggcttatttatgtaataggaataaagcagttctgcagcgtgttttgcagcctcgtccaatgtcagcgatttcactgactcccgctccatttgatcaagataccctataatgatcttttttttcatctgacgtttttcgagaaggtacagcagaaaatcgtccttgctgacaaaatgaacataaaatgctcctttgctgtacccggcggctctgctgatatcttctacagaaaccggatcatacgctcggtcaatcaacaaattcacgccagcgtctataaaactttcaaatgttgcttctcttttaatttgaaatttgttttttttcatatttttctcctggcggtaatgattacccttatcttacaccggatcaatctttagcggtatttatttctttgaacggttatgctattcggtttcccaggggtcatttttaataggctaaatgatttattttcatttacatactatccagtcagtatttaattgtttattattataaataaggtccattggttatattagtcatttttttagggaataggtaggtggtttttccttcagtttgtgaacaccgagcaactatgtgtgaaatttgttgtactcgcctcatcatcgcgctggcttgtcttttattgcccgcatgttgcaggaaaacattttatacaattggaggttactatgaaaactcatgttaaaaaagatttggacaaaggttggcatatgttaattcaagaagctagatccattggattaggcattcatgatgtgaggcagtttttagaatctgagacagcatcgagaaagaaaaaccacaaaaaaaccgtccggcaagactagtccgaacaggcggatctatttacctctggcttttctatcacctgatctgagttttcaccatatcctctattcaaaagcaaatcgctgcgctgagcttgaggacaaacggtgtgtcagctaactacgacagacagccggtgatgcgatcacctcttggcacatgcattgtcataaagaggtgatgcgaacatgataaccgtgctctggtaaacagcagctttgctgagaacaagctgcattcggtgaggttttgaaagcaaactcgtttatacacggccgagcttgaaaaccttcgcctgtctttagaccactgtgttcacctcttcacgacttccttcttttttcatcctccagatattgttcaacgcataaatcggactttcagtacatacctattggtgtacctttttgcttacgtttagcgaataaaaggaggaaagccatgtacaaagctgattataaacagattgctgcaacgccgtcttttcaagcttttttaaagcagaaacgcgcttttattgttccttctgcgattttcttttttgtcttttatttttcactccctgttttgacatcttatttcacctttttgaatgcaccggccattggagctgtttcatgggcttggctgttcgccatcgcccaattcgctatgacctggatactgagtactgtgtattcccggagagccgctcatttcgatcagtatgtaagcgctttaaaagagggtctgaagggtgaacagacatgaatatgactgcttttttattatttttggcgattgttggcctgacgcttattatcacgtattttgccgcgaagcggacgaaaacgacgagtgagttttatacggcgggcggcgggctcaccggcgttcagaatggactggcaattgccggtgactacatgtctgccgcctcgtttctcgggattgccggaatgattgcgttatatggatttgatggcttcttttacagcatcggttttctggtggcttatctcgttgtcttgtacatcgtggcggagccgcttcggaatcttggaaagtacacgatggcagacatgattgccgctcgctttaaagaaaagaaaatccgcggtgtcgcggctctcaataccattgccatctctactttttatatgatcgcccagctcgtgggggcgggcgcgctgatcaaactgcttctagggcttgattatactatggctgtcctcatcgtcggagtgctgatgaccatttatgtcgtgtttggcggcatgatcgcgacaagctgggttcaaattattaaagccgttttgctgatggccggcacactcgtgatttcgattatcgtgttttcgaaattcggctttagcctcaataccatgtttgaacagatgaaaacggctactccgctgggcgctgattttttgaaccccggaaataaatacaaggtgccgcttgagaccttgtcgttaaacttggcactcgtgctgggaaccgccgggcttccgcatatattgatccggttttataccgttaaggatgccaagacggcccgtacatccgttgtgtcagcgacatggattatcggtgtgttttacattatgacggtatttctcggctttggtgccgcggcatttgtcggttttgacgcgattacggcggctgatcaagcgggaaatatggcggctccgcttttagcaaaagcgctcggaggagactttctgttcgcgtttgtatcagccatcgcctttgccaccattttggctgtcgtgacagggttggtgctgtctgccgcctcagcatttgcccatgatatttacagccagatcatcagaaagggagaagcaactgaaaaagaacaaatgaaagcggccagatgggcttctgtcgccgtgtcagtgctctcgattctccttgcgatttttgcacaatccttaaatgtggcgttccttgttgcactcgcgtttgcggtagccgccagcgcaaaccttccgctgattgtgtttacagtcttctggaaacgattcaatgcctcaggcgctttatcgggcagcctgacaggcctgatcagcgcgcttgtgctggtatcgatgagccctagtgtgtgggacccggctggaggtgctatttttaccggtgatccgctcattccgctgtctaatccaggaattatttccatcccgctcggctttctcggcgcgtggctcggaacggtgctgtcgtctgataaaacaattgatgaagatacgtttgcagaaattcaggtgaaggcgcatactggcgtccatatggaacaggaataaaaaaagctctctttatagagagctttttccttgtcttttcttctgttcttcagaaatcgctttttcaaatacatccttgccggcagcacctggaattacagtgtcgccaataataaaggttggaacggctgtgatgtcagcctcttcataggcgtgcttcaaggcttggcgctgcacgtcctgatatgttcttatttccagtgctgatttgaatgatgcaccgtctaatcccacttcctcggcgagcttcgtcaagatgtcaatgtcgccgatattttggccctcctggaaaaacgcctgaaagacacgggtgttgtattcatgtcctttatggtattccttcgcaaaatggaagccttcaaacgcgaggtctgtatacggatggggcgagacgtttggaaaattgatctcgacccctaatttctccgccattggctgaattgatgtctgccacatgtactgtttggaagggtcattgaccggatcaagctgaggagatgggcttggacgcagttcaaacggcatccactcgacttcaacatcctttccttttatcgcttcttcaaaagcggcttttccaacgaaacaaaatgggcagacgtaatctgaataaactttaatgtgtactgtcatgataatctcctttcgtataaattgattttaaactgtaacaattaaagttacaactgttttttaaataaagaagccgataaggcttcttttatgattccagcaaacgctgggcaatatattctccttttttgcagccgcctgggcatgcatataaagcagaaccgattgtttgtgtatattcgtttaacgcatcctttgctgaaagagccttcagcatcgggataaactgattgtcgggatttttttgaaaactgataaacagaagacctgcatccatatagccggttttcggatcaagtccttctgtgtaagagaaagctcttcgcaaaatttgttttccagtagatttcgctagactgacgtgtgaattagacggaatttgattcagcttcacgggatctgtttcctttttctgtccgaaaggcgcccccgagctttttctgcggccgaaggtatcctcttggtccttgagggaagagcggtcccatatctcaaggaacattttgattttccgaaaagccatataggtgccgcccgtcatccagtcaggctcaccagactgaatccacacgatcgagttcatcaagctgtcatcctccgtgctctggttgcctgttccatctttgaacccgaagaggttgcgcggtgtttcaccattttttcctccgcttaaaaagcctttgttcacaaagcggacctcacaagtgccgaccgcttgatttagcaggttacgcagcgcgtgaaacgccacttgctcgtcgtctgcacacacttgaatgcagatgtccccgcctccctgcttttcatccaggttgtcattgggcatcgctggaagagcggctaggtgcttcggttttttgcttttcagcccgaaacggtcctttccgtctttttcaaaaaagccaggcccaaatccgaatgtgaccgttaagttggaaggggataaatcagcagactcacctgtatcctgcggcggcagatattgatttctctgctccgctgacattttcttgccagacgtcagcatctgtgtgagacttgtccagtttctaaataacgtaatgatgtcgcttttgtcttttgctgttacatccagtgcagcaaaatagacatacgtctgatgggcagttgtgattccggcctgatgctttccgtaaaacggaacaatctgctcctcctctttttcatcctttttcgatggcttagccgcagtctgaacaagtggagcgagaccgccgagtccgctggcaccgatcgcaacggctgcccccgccattgcccccattttaaaatgtcccgtctgtgaatttgttctgactttttttgttcatcgctcatgctgttacaaaactccttttatagcacattcgcaatcttcgacatggtttcagaaagagtcgtcagctttgtgctcagctctctgatttgcttttcacttaatttatcataagacgtataggactgatcatttgttttgtattttgccattaaaacttcaaattcgctgaactccgtatccagtttttccgtcaagtcggagtgatcttttacaagcgcgcttttcactgtttgataaacggcttcggagccttccacatttgccataaggtcgactaaatcgattcgtgagtagcgctcttcttctcccgtgattttcgaaatcccggcttcgttcagaagctccatcgcgcctgctacaatttgttcaggtgttaatttcagtgattgaattgaaccgtcaagctcttttacatccttgagaagctggtcagctgttgccttttccccggaaatatcttgatccttccaaatggccttctcaagcttatggaagcctgtccatttgtctccttcttcaacatcgttttctcgagcatcaattttcggatcaagatctccgaggctttcagcgatcggttcgattcgctcgtaataaacacgcgctttcgcatataacgttttggacttttcgatatcgccggatttcacagcacccgtaaatgcttcagtcgctttgacaagctggtcactctgctctttgacatagcctttatactcatccgctgcttttgccagctgatcgctagcctttttgccgctcttcttcgcttctgtcaggtcttctaaggacgctttcagtgactcggattctgtcttgatttttgctgtatccggtttgtctttttgcgcttctgtgtagattggctgaagatgcttttcgatttctgtatattcgaatggatagtcgctgcgaatatcgttttcaaaggaaagccagtagctgtttaactctttccccttcttttcaatctctttttggtctcctttttccgctgagtcattcagcttagaaatgatggtttccattttatttacggatgcggtgatttctttagtgatcccgcttttttcagatgaagctttttctttagttgaagatgtgtcgttggctccgcagcctgcgcacagcgcaaggatgcatccggctgatacagcgatttttgtgaaattcattttgtcagttcctttccgtttgtaaaatgttttgccgcttctgaaacaagcgcaatcagtaaaaagaggaaaatcaacatttgcggaatcgtgctgtacacagacggataaattcctagcaccgatacagacggcagccagctttctgcatcagacggaagaatgcccgccagttgaaggctgtgaacgccggttccgagaaatttcacgcacatatacaggacaaccgccattgatagaagaaaaaacggcttcaatggaatgcgcattccgagcttgatcatcagaacaccgacgatgacgagaacgataagccctgcggcagttccgccgatcagttcagtgagcgggagcttcccgacaagcccgatgaaaaagatgaccgtttcgagaccttctcttacaactgccagaaatgcaatgagcgcaaaggaaagcaggcttcgtttttttagtgcctgtgacttctggatattgattttttctctccatttatccattgaggcgtttctgtgcaaccacaccccgacatacaaaagcatgacagcggacagtacgccggtgacgccgccaagcaagaaattgttttctccgaatacactggaggagaacagaaccgtgacaccgatgccggctgctaaggaaacagccatgccggcagacgctccgccccagatccatgccgaggagcgcgtgacccgcgctttttttgtcatggttaatagtgctccgatgacaaggagggcctccatcccttcacgaatcgggatcagcgccgcatcccaccagctgtagctgcttgaagcgatcggctcgagcaattgaatcatttcgtcaatttgctttgataccttttcgggatggctgccgatctccgccttcatcagtgccagattttcctccgatgtcgtataggcttctttcgattgggacacgacgtctccctctacggcgagccaggatgtaactaaattgtcgattgcggatgacgcttcatccaattgttttttttctatgaactgttttgtgtctttcaagctttgtatataggctgttaaggacgcccttgattgacctgaggatgtctttttcagcacgacagcctgctgataggtttctaaatgagacgcaagctcttcaagctgtgttttgagcttgcctgcgtcttgattgataaaagaaagagaaatcatcgcgatattcgcgtccatttcactgtgagaagaaaggttttctttcttaatagaaggttcttcttttttccacttcgctttgaaggtttcaaacgtttgttgtgccgaatccatatccccgtcttttacggatttgatcatttgcttgtttaattgaattaatgcggcgatcggatcatcttccgcatgtgccgcagaaccgaaaaccatcaacaagctgaatagaataagtgccagcccccgagccatcatgttcctcctataattgaaaatgattatcattgtataacataatcatagccagttcttgtcctttgtcaattaaaatttgaaggtctgaaaaccttgatggacagcaaaaaagctgtccttttacagaacagccttttgaaggaagatgaacgattatctttctgttttatatgtttgaatttcctcacgaaacttgcgtgcagcactctcaggatcttccgcctgactgatggcgctgatcatactgacgccatcggcccccgcttggataacaggtgcggcattatctattgtgatgccaccgatgccgacaattggaatgctgatgccttggcggcgcactgcttcaataagagataccccttgtaccgctctcgtatcttttttcgtttcagtcggatagatcggcccaagcccgacataatcggctccgtcttcttcagcttgcttcacctcagacatcgtatgggcagaaacgccgagaatcatatcacctatggcagctcttacctctttcgcatttgcgtcttcctggccgatgtggataccgtcagctttcagcttcagagccaattccacatcatcattgacaatgaacggaataccagcttcacggcaagctgcctgcgctttttcagcaaattcaatccgagcctctcctgtcagcgcatccccgcctttttcacggaactggtacagggtggcaccgccttttaacgctttttgtacaactgtaacaggatcggctttcgtattgtttgaccccataatgaagtatacagataataactctttcatcatttcccgagaaatacgagtcatgagacagtcaccctttctatagccgcccattcttggacgtcttgttcagtaacagttgaaagcttgttcagcaattcaatctgaaagcttccagggcctttgtcagccgtctgctgtgcggcaagctgagcggcgaccccatacgaagtaatggccgcaatagcagcaaacaatggattttcttccacagcgcaaaacgcaccgacgacggaagtcagcaggcaaccggcgcctgtcacttttgtcagcagcttgtggccgttatgaagggtgtatacatgtgatgtgtcggcaatgacatcgacttcaccagtaatcgcaatgaccgtgtttagcttttgtgccgcttgctgagccagccggatgatgtcgcctccgccttcacccgcatcaacacctttgatcagccaatccgtcacaccgacggtatgggcaatttccgccgcatttcctctgattgcagcaaggcgaacctcacgaatgatgtcacgtgccgattcagttcggaacggtgttgctccggcaccgacaggatcaagaatgacgggaacgccatgttcattggctgatttccccgcgatgatcatcgcttcgactgactccttgctcagcgttccgatatttaaaacgagtgcacccgcaatcttcgccatatcggcgacctcttcttttgcgtacgccattacgggcgatgcgccgagcgcgagcaggccgtttgctgtgaaattcgttacgacattgttggttatgctatgcaccagtgggctgtgccggcggacagcagtaagacattttgctgctgattgtgcatccatgtttgcatcatcctttactatcttttttcgggtcccataaatacgatttcgtatgttcgagccaagctctggcggcaaacgacaagtaccggtcctttctccaaataatggcgaggtgccaagggatgaccggatcgacaagcggaatgactttcactttttccgggtcaaggccgcggcagatccgttccggcaaaagcccgatcccaaggtttgctgataccatctcactgataaaatcccattgtgatgtttcataaatgatatggggccggaacccagccttgatacattccgtcataattcggttgtgcaggacaaaatcctctctgaagaaaataaaaggctcgtccttcaactcacgcagctgacattctttctcatcagccagccggtgggaagggtgaacgacaagcattaaggtttcttttacgattgtaaacgaatgaaagatatcttcgtttgcgggaaggaccacaacgccgatatcaagagagccgtccccgacaccttcttggacttttatagaaccgtcttcgactagctgaaaggtgacattcggatagttttcacggaaatcgccgagcactctggggaaaaaccccgatccgatcatcggcggcagtccaatccgtacgtgccctttcttgacttccataatatcatttaattctgacgtcaggttttgaaatgatttaatgatttcctgcgcctgcacatacatgctatgaccggcatcagtcagttccacctgcctgccgtttcggtaaaacagttcaattccgagctcttcttctaaatttttgatcatttttgatatcgtcggctgagatacataaagggattgggaagccttcgtaaaactttttaaacgggcgacttccaagaaatatgttaaatggcggatatccatgtgcttcaccctttctatagacaaaaggaatacttcttattcttaatatatattttacctatagagagaccttatgtacaataagtatataagggaggcatcaatatgaaaaaactgttgctaaccgttattcaaatcgctctgttatttatatttgctcggctgattaattgggtgacagcccttcttcatataaatattcccggcagtataatagggattgtgattcttttcacattattgcactttaacattatcaagcttgaatggatcgagcttggtgcagcgtggcttctcggggagctgcttttattttttatcccgtctgccgtcggagtgattgaatacggagacattatgtcgaaatttggtgtcagcattctgcttgttgtcatcatcagcacgtttgtcgtgatggtgtctacaggaacgcttacacaactcattgcaaagagaaaggagaaaaagcatacgtgttcatcggaattgtaagtttgtttttaacggttttggtgtatttaggagcaaaaaaggtatatcaacgctttccgcgtgtttatacgtcgccgctattggtgacgcccgctgtgttagtcggtctgctgctgctggtgaatgtcccgtacgagtcctataatctcggcggcggattgctgaccgatatgctacagccggccaccgtggcattcgcgatcccgctatataaatatttccctgttttaaagaaatacgcagtggaaattattttgaatgtggccgtcggttcatgcatcgcgattatttctaccgctcttattgcgaaatggcttcacctcggcaccggcttaattgacagcctcgtcccgagatcagtgacaacgccgatcgcgatgaacgtatctgaaatgatcggcggaatgcctgccgtcacagccgtgtttgtgattttaaccgctttgctcggcacagtgatcggcccgatggtcatccgctatttccgtattgataacgaaatcgcgcggggcgtgctgctcggcacaagcgcacacggagcgggaacgtcaaaggcatttgagctcagctctgtgtccggcacgatttcaagcgtatcgatgatcttagctgcgattatgacgctttgcgcggcgccgtttttactttcatttatgtaaaaaactgtcctctcgagggcagttttttttatgtgcttccccttattgaaaagctcgcaaattacaatataatgtaatttgtggataccaaaggaggcaccctgatgcacaacttgcaggtgaggcggcattacgccgcgttaaaaggattttatttgtttgcttttctcggtacgggcagcatgattcccttactcagtatgtatttaacgaaggaacagcatttaagcggatcacaggtcggcttgatcatgtcactgggcccgattgtgatgattttctttcagccgttttggggcatgctcagcgactatacgcaaaaaacgaaaggcctgctggcggtttgcacatcaatcacaggcatcattggattagcctatattgcatttgacagtttccctctgtttattttgattgcggcctgttttgcagcctttcaaagcacgattattccactttcggacagcatttcactaaggtacacacaagaaacaaatggcaactacggcggaatccgcctgtttggttctctcggcttcggtgtcgcggtgtttgccatgggacaggtgacgaaccagctgtaccccattcacgtgatctttatctttggctgtgcctttctatgcattgctgccatattggcttcacaaatgcccggccagcagaaaacaacaacaaaagtcaatatccgcaaaggattccgggagcttatcagcaacaaaactttcctcatctttatgatcatcacctttacgacatttgctccaaacttagcgaacaatacgtatttcagtctttttctggacaaaagcggcgcgtcactttccgctatcggcattttatttttcatcggtgtcatttcagaaattccatttatgagattcgcccaaacatttatagataaaatggggctgctcaacgtcattatgctgtcaggcggagtctcattattcaggtgggcgctctatttcacggcgccttcactatggatcatttatgtgacggtctttcttcagggagtggccatcggtttatttatcccggcggcgcttcaatatgtgaaaaagattaccccaagacacgttgaagcgacagcactgaccatgtacgccgccatcggcaacgggttcggcaactggttctgcacatttgcaggcgggtatatttttgactacgtatcgattttcgcagtctacttgctttttggcattctgagcatagcaggctttggcctgacattatatttaatgaaggctgaaaaaaacaaacatacacttcatcagccggctgttacttttaaaccataatgactataatgaacaaaagaaaggatgtgcgttatgaacgggcaagagcgaaacagcatttcgaaagggttgcaggttgatattgtattgaaagcagatcaaaaaacaggaaaactgacgagagggacagtgaaggatattttgacgaaatcaagctttcatccgcatggcattaaagtccgtcttgaagatggccgcatcggccgcgtccagcagatcatttctacataaaaaaaagctgcccctgaacagggcagctttttcattattttttctgcagaaggaccactttcaggtagttgccttccggaaatgccgaaatcgttttgaaatcctccggcagcgtaaattcctcaatgatggtgtagcgttcgttcgtttctttaaaggcggcatcgataaagcctttgaatttcttcatgccaaaggcgctgctgtttgtagaggcaacaatgacacccttgtcagcagtgatggcgatcgtttccttcagcaggtttttataatccttggccgcgctgaaggtgcgtttttttgtgcgcgcaaaggaaggcggatcgagaataatcagatcaaagcgcaaatccttttttgcagcatatgaaaaatagttaaacacgtccatcactttaatgtcgtgcgcttcgtaatccagcttgttcacgctgaattgctcgatcgttttggccagacttcggtttgccacgtcgacgcttgttgttttctccgctccgccaagcgccgctgccacggagaatgcacccgtataagaaaatgtatttaaaacggttttcccttttgcatagcggtctctgatcgccttgcgcacatgtctctgatccaaaaagatgcccgtcatggcgccttcattcagatccaccgcgtattgaatgccattctcctggatgatgatcgggaactcgccccttctccctttcacgaagtcatcatcttcaacgtattgtccagccgtgtcgaagcgtttcttctcgtaaatcgctttataatcaagatccagctcatccaatgcggaaatcagcatgtctttaaaggtgtaaattcccttgctgtaccattgaatcagcaggtagccgtcataatagtcgatggtgacgccgccgacaccgtcgccctcaccgttgaacaggcggaaagctgttgtatcttgagcctcaaatagtttggcgcgcgcttgggccgcttttgttaatttggtgagaaaaaatgcctggtcaacctgttcatgtttattgcgggtaagcgtccagccgacccctttgttttgcaggccataatagccccgcgcgagaaactcgccgctctcagacacgatatcaacgaggtctccttctttcatgtgccccgcactccctgcgagagcttctttttcaataaggggatagcctttttttattttggcagcgtgtgctttttttagggtgagtagcttcatatatgtcgtcctctttctgtttgctttctcttatcgtaccacaaaacgccaagatgtctgcattgacagaaaggaaaggtttttctacgatagacaaaaagagtttcgaggaggagcagcatgccaaaacgaattgaccatacaggcatcatggtaagagatattaacgcgtccatcacattttatgaagaggtactcggcatgaaattgaaggatcgcatcacacacacgaacggtgtaatcgagcttgcttttctcggctttgaagacggcccggaaacagaaattgaactgattcaaggctacagcagcgagcttcccgctgaaggaaaagtgcaccacattgccctgctgactgatgacatcgcggctgaatatacaaaagcggaaaaaatgaacgcaaaatttatcgacgaggagatcacaacacttccaaacggataccgttatttctatatcgaaggccctgacggtgagtggattgagttctttcagcggtaaaaaaaaagaacgtacattttgtgatgtacgttctttttttatctataccaactgatatacgttgactcatcgcaaatcatagcttcccagcccatacgctcaaccaattcatggatgtttttatctttggctaaaaagacattaatgaatgagtcatatacactcataaacacaaaatccattttctcatcagttaaaacgagctctgctgcggcttcatcaagaaccgtccgcaagttggcctcagttatgtccaaaacgccgcggttttccacaatcggttctgcgtaataaaaccgattggatccgttcgcacctaatacctttaccaaactcggaatatgaaaatttgaaatatgatcctcactgggataatagaggtctccatttatgttttcatgtaacacctcagccaaatcctctctcgcgaactcgtcccttaaagcgcctatcgacgtcattaaagccagcgccagctcagcatgtgtttgaaagccgcaagaagacataaccttcttccaggaaacagccttgcctattcctcttatttcatcatcgtttggataaatatgctcgtaatcattttttctttttgcattctcccatccttcaggcatttggataaaaggagaaaagataagtgcagcagatgagtattcaactggtacttgttgtaagattggtgattcgtcatctaaccatatataatctagcatgcgcacctcctttacatattctaacattctctttcgtttaaaaggagatgatcagccctatgacaggctgatcatctatcacatcacatttttatccccagattcaaccgcactctcttcccgccatttttgatgatcccatattctgaaaaacggatagtagatggcacaggtgatcagcagattcaccagctgcataacggcgcccgacacctttccgcctgtcgccaggtaacctgatatgagcggcggcatcgtccatggcaccgcgattccggccggtcttgccaccagcccggtgctcatgccgatataagtcgcggtaatcgtgaggagcggtgcgatgataaatgggacaataaggagcggattcatgacaatcggcatgccgaaaatgatcggctcgttgatattaaatagcgcagggccgattcctaatcgtccaagctgcttcatttgtttgctccgggagcgcacaagcatcgtcaggacaagcgccaacgtcgccccgcttccgccgacattgatccaaatttgaaaaaactgagtcgtaaaaatactcggcaacgcctcgcccgcttggaaggcaagacggttggcatccatcgcgccgtaccaaatcggcgccatgattccgccaatgatggaagccccgtgaatcccgcacgaccaaagcagcatctgcacaaattcagcgatcaggcttccgccgagactgccgccaaggatggaaagcggtgtcccaagcaggtctcctacgacattgtgcagactctgaaaaggtgtcatttcaatcaaaaggcgcgccagccacacgagaaacacaatgataaagccgggaatcagcgcgacaaacgatttgcttaccgcaggcggcacaccgtctggcattttgaagacgatatttttttgaataatgtaccgatagatttcggttgaaaacaaggcaatcagcatggcgacaaataagcccttgctgccaagtagcgtgatcgggattccgccccctaccatgatggactccgttgagccatccggtgtaaacggcacctcaaacggcgttgccaatagaaatgcggcaattgaaatcgctccggccgaaagggcatcaacaccatagctttccgccagccgataggcgatcccgaaagcggcgatcatcgccataatatcaaacgaagcattgacgggatatccgagcttatcagcccactccttcccaaacacactcgccatgaaatcagcataccccggaatcggcaggctcgttaaaatcaagaagacagacccgataataatcagcggcatggtcaggataattccgtcacgcaaagcgctgaggtgccgctgtccggcaattttcccggcgacaggcattattttttcttccattacccgagtgaatgcgctcatcttaaaagcccccttttcacattgctttgtgaacaacctccgcaatgttttctttatcttattttgaaaacgtttacaaattcatttggaaaatttcctcttcctgcggaaaaaatctgcattttgccaaacaatcctgtctatgaaaaattttttccttctaactattaatctctcttttttctccgatatatatatcaaacatcatagaaaaaggagatgaatcatgaaaaacatgtcttgcaaacttgttgtatcagtcactctgtttttcagttttctcgccataggccctctcgctcatgcgcaaaacagcagcgagaaagaggttattgtggtttataaaaacaaggccggaaaggaaaccatcctggatagtgatgctgatgttgaacagcagtataagcatcttcccgcggtagcggtcacagcagaccaggagacagtaaaagaattaaagcaggatcctgatattttgtatgtagaaaacaacgtatcatttaccgcagcagacagcacggatttcaaagtgctgtcagacggcactgacacctctgacaactttgagcaatggaaccttgagcccattcaggtgaaacaggcttggaaggcaggactgacaggaaaaaatatcaaaattgccgtcattgacagcgggatctccccccacgatgacctgtcgattgccggcgggtattcagctgtcagttatacctcttcttacaaagatgataacggccacggaacacatgtcgcagggattatcggagccaagcataacggctacggaattgacggcatcgcaccggaagcacaaatatacgcggttaaagcgcttgatcagaacggctcggggatcttcaaagtcttctccaaggaattgactggtcgatcgcaaacgggatggacatcgtcaatatgagccttggcacgacgtcagacagcaaaatccttcatgaggccgtgaacaaagcatatgaacaaggtgttctgcttgttgccgcaagcggtaacgacggaaacggcaagccagtgaattatccggcggcatacagcagtgtcgttgctgtttcagcaacaaacgaaaagaatcagcttgcctccttctcaacaactggagatgaagttgaattttcagcgccggggacaaacatcacaagcacttacttaaaccagtattatgcaacaggaagcggaacatcccaagcgacaccgcacgccgctgccatgtttgctttgttaaaacagcgtgatcctgccgagacaaacgtccagcttcgcgaggaaatgcggagaaatatcgttgatcttggtaccgcaggccgcgatcagcaatttggctacggcttaatccaatataaagcacaggtaacagattcagcgtacgcggcagcagagcaagcggtgaaaaaagcggaacaaacaaaagcacaaaccgaaatcaacaaagcgcgagaactcatcagccagctgccgggctccgacgccaaaactgccctgcaaaaaagactggataaagtacagtcatacagaaatgtaaaagatgcgaaagacaaagtcgcaaaggcagaaaaatataaaacacagcaaaccgttgatacagcacaaactgccatcaacaagctgccaaacggaacagacaaaaagaaccttcaaaaacgcttagaccaagtaaaacgctacatcgcgtcaaagcaagcgaaagacaaagttgcgaaagcggaaaaaagcaaaaagaaaacagatgtggacagcgcacaatcagcaattggcaagctgcctgcaagttcagaaaaaacgtccctgcaaaaacgccttaacaaagtgaagagcaccaatttgaagacggcacagcaatccgtatctgcggctgaaaagaaatcaactgatgcaaatgcggcaaaagcacaatcagccgtcaatcagcttcaagcaggcaaggacaaaacggcattgcaaaaacgattagacaaggtgaagaaaaaggtggcggcggctgaagcaaaaaaagtcgaaactgccaaggcaaaagtgaagaaagcggaaaaagacaaaacaaagaaatcaaagacatccgctcagtctgcagtgaatcaattaaaagcatcccatgaaaaaacaaagctgcaaaaacggctgaacgccgtcaaaccgaaaaagtaaccaaaaacctttaagacttgcattccaggtcttaaaggttttttacattctaagaacatcgtacacaacctttttcccatccgcctcacaggcttttcatactattgctatacagccatgaacagcataaaatgaacgttattacagttatcaccacatatggcgggattgtgactgggcaggcaggcaagacccaatgatgcaaagggagtattaatgcctaaaaagcagggcattttaactcttcttttcgtgttgggctcataacggcgccttggacaaccccctattctcatgctccgtcgtcgcgtcgacgcgggcatttttgtcattttcagccgatatttctcacttttttcattttgattgtcaacttttcatttgatacgatgaacaagccgacttttcttcagcaaaggaggttttgattgcttgcataaagagattgcaaaagaattactgctgctcgcaggaggaaaaaacaatattatcagcatcagccattgtacgacccgtcttcgttttgatgtaaaggacgagacgaaaattgatatacatgccattgagaacctgcaaggtgtgcagggcacctttttccgttatgggcttttccagattatcttcggagcaggcgtcgtcaacaaaatatataaagaagtcgttcatgtatgggagaacgcgccttctgaagaacctgtccaccagaaaaaagccagccggaagctgaaccctgccgcagcttttgcgaaaacactgtccgatatttttgtgccgattattccggcaataacagcaagcggcctgctcatggggctgatcggcatgattaaggtgtttcactggttcgctgccggcagcccatggattaaaatgctcgacctcgtgtccagcacagcctttattttactgccgattttagtcggcttcagtgccgcacggcaatttggcagcaacccatacctaggggcagtgatcgcggggcttttgacgcatcctgatctgctggacccgtctatgctcggcagcaaaaccccgtcttctttagacatatgggggcttcatatcccaatgatgggctatcagggttccatgataccgattcttctttccgtttttgtcatgagcaaaattgagaagctattaaaatcgattgtgccgaagtcgcttgatgtcgtgatcattccctttattacggtcatggtgacaggatgcctcgcgctgattgtgatgaatcccgccgcgtccatcatcggccagatcatgacacaatcgatcgtctatatttatgatcacgccggcattgccgccggagctcttttcggcggcatctactccaccatcgtcctatctggattgcatcatagcttttatgcaattgaggcaacgctgcttgctaatccgcatgtcggtgtcaactttttagtgccgatatggtcgatggcgaatgtggcccaaggcggagcggggcttgcggtattcctcaaaacgaaacaatcaagcctgaaaaaaattgcgctccccgcttctctgaccgcgtttttaggcattgttgagccgattgtattcggggtaaatctcaaattgatccgtccctttatcggagcagccatcggcggtgctattggcggagcatacgtggttgcggtacaagttgtggcaaattcctacgggctgacaggcattccgatgatttcaatcgtgctgccgtttggcgccgctaattttgttcattatatgatcggtttcttgatcgcagccgtctctgcttttatagctacattgtttctcgggtttaaagaagagacagaataactggatttattcgttttcattcataaaacgggggatgaaaggacaaaaaagctatgaaaattaaaagaatcttaaatcataatgctatcgtcgtaaaggatcaaaatgaagagaagattctcttgggtgcaggaattgcgtttaacaaaaagaagaatgatattgtcgatccgtcaaaaatagaaaaaacctttatcagaaaagatacacctgactataagcagttcgaagagattttagaaacattgcctgaagaccacattcagatttctgagcaaattatctctcatgccgaaaaagagctgaacatcaaaatcaacgagcgcattcatgtcgctttttcagaccatctttcttttgcgattgaacgcctgagcaatgggatggttatcaaaaatccgctgctgaatgaaatcaaagtcctttatccaaaggagttccagatcggcttatgggccagaacactgattaaagataaactggggattcacattcctgatgatgaaatcggcaatatcgccatgcatatccacacagcaagaaacaatgccggcgatatgacacaaacgcttgatattacaacaatgatccgtgatattatcgagattatcgaaattcaactgtctattaatatcgttgaagataccatctcttatgaacggctcgtgacccatctccgctttgccattcagcatatcaaagcaggcgaatccatttacgagttggacgcagaaatgatcgacatcattaaagagaagtttaaggatgccttcctgtgtgccctaagcatcggcacctttgtgaagaaggaatacggctttgagtttcctgaaaaagaattgtgctacatcgccatgcatattcagcggttctaccaacggtcagtcgcacgctgagacaaacaaaaaacgcttttgatcatctcaaaagcgtttttttatatctgtattattggttgatcgccgggttgctgatcgtattccacttcgtataggacatgtaatggaaatactcatcgcgatacggatgttttgtattggagttccaaggcttttctccgccgcagaagtgcacgattgccgggttttctctcgtttcattatattgcttccgccctaacagagtcgatggggttttcagctttaacatgatataggtttgagcgttccagcgcggatgaagttcataccactgatcatataaaatcgcattcagtgcatcttggtcatgcagcacaagaaagtcttcgtctgggtgttcattgataaagttgatgactttttctgtgatgttttgctttctccaagactcaaaatcaataatcatgatacctgagttaaaatacttccctgtatcagtgacgttcatttctttcaggcgttcatgctgccccgcatcctcaacagcggctacggtgtatggcgcaatgtctaagtcccatagcttagaaatatcctctaggacaagcgcatcacaatcgatgtaaatcattcgtttgatgctttcatccttaattaagtcgggaatcgaaatgcggtaatacgcggcttttgtaatatggctgctctctaccgcatgttcatacattttggtatccacttctaaaaactcaatcggcactccgaatttcaaagtggtttcttccagtctttttttgttatcaggcttaattccgccatcaatgacgtataattttacctctctctcctgatccatgttagtcaataaagaaacgaacatcccacctaaatgacgagcataattatcatctgcgcatgatacgatatgcatgatttcatctttcctcaatggtattcatctccctttttgttgtacaagttacataccctttttcaaaaaaataaacacgttctccgacatttttttaaacagaatgtgtgatacaacaaaaaaggtgtcattttttgaagatgcgataaagccagtaaagaatgaaaaagcttgcgattgtgatggcttcagccgagacgatataccacggccatggcccgagaacatctaagagagaggatccgcccggttttttcgtcaaatacatataattcgcgccaagccagcgatcaatcaggaaaatacagacgccgtacacattaacaagcaggactgtcacccataacgagcgctggcccattctgtaggtgccaatcacagccatcagcagacaggataaaaacacagacccgtgagaaataaaaaagaggatatatcggatatgcggaaatgaaaacattccgaggtcaggagtggcaagagcctgaatcgaactgccgatgccgacaaaaaacaaaaacacaaacagctttctgctttttgtcactaacataatagctgacaaatacaccgacaggtcactaagctggagaggcaatgaagtgcgcaccgaccacctgcccgtggcgaccaaccatatttgatagccgatttgcgaaccaagcaaaagaaacacaaacagagaacgcaaaaaccggctggccctcggctgcttgaccccctcttggaacaaaaccaacagaatggccaaaagggcgataatcgctaacgtcactacatgctctgtcgaaaacagatgaaacggatcatgcttatagacggattgaacatatttttgcaaaactgcacccccgtttgcggttttttgtttattttggcgttgtttgggctttttttattcaaccgatatatgggcttgaagttcacatcatcctctgttacaattcgtttcatagctaatgattctgataatttaaggcaggtctaaaaaatggaacgttcacatcaacatcagcagcttcggaaggaagaacacgatacactttctaagctcaaacaaatgcccgtcgagtcactcaacctggaagccatttcgatcgctacgaatctgtatcggtctgcacaaaggctccgtgtcaaaatggagactgaggttctttcttcctataacctttcttggaccgctttctccattctttatgatctatgggtatggggagcgctcgaaacgagaaaaatcgctgagctgtcagggatatctacagctacagcaagcaacgtgatcaaaacgctcgaaaaaaagagtttttgccgtaaaagcatcgacacaagagatcggcgactcgtgtttgtctcaatcaccgattccggcaaacaagcgatcgaagaactctacccggagtttcacaaaggggaaacagagctcattgcgggaatgacgaaggacgaacagaaaatattgacagggctgcttagaaaggtagctgacaatcttcatacaacataagctttgacgggaatccagtagcggtttgtctccctgtttcagagagccggcggaaggtgcgagccggcacacagcaaacgtgaattacctccccgagctttctttgtgaccttaaaagtagcaaagaacgggaaaccgttattcgaatgagcggaagacgatgtcttcaaccagggtggtaccgcgtgcattgagccacgtcccttatcgggatgggctcttttttgtgtttgtaaaaaaggaggaaaaatgatgaaaacatttgagcagctcacagcgtcacagcaaaaagaggtagaaagacagcttcagctatacatgacaggcgcccacgaagtcataccgccggaggaattaaaggcaaagctcgtgaaatcaatttccacgggcacgccgcttaaaattaagctcggattagatccgtctgcaccggatgtacatttgggccatacggttgtgttaaataagcttcgccaatttcaagaaaacggccacattgtccagctgttaattggggatttcacaggaaaaattggtgatccgaccggaaaatcggcagccagaaagcaactgactgatgaagaagttcagcacaatgccaaaacctactttgagcaattcggaaaagtgcttgatccagaaaaagtcgagcttcactataactcaaaatggctgaaaacattgaatctggaagatgtcattgaattagcagggaaaataacggtagcccgcctgatggagcgcgacgactttgaagaacgcatcgccatgcaaaaaccaatctcactgcatgaattcttttacccattgatgcagggatatgattctgtcgttctcgaaagtgatattgaattaggcggaacggatcagcatttcaatgttctcatgggacggcatttccaagaacgatacaacaaagaaaaacaagtcgtcatccttatgccgctcttggaaggcttggatggcgtcgagaaaatgtcgaagtcgaaacacaactacattggcattaacgaacatccaaacgacatgtacggaaaaacgatgtcactgcccgacagcctgatgaaaaaatacatccacttggcgacagacttagagcttgaagaaaaaaaacagctcgtaaaagacttagaaaccggcgcagttcatccgcgtgatgccaaaatgcttttagccaaaacaatcgtccgaatgtatcacggagagaaagcagcagaagctgccgaacactcgtttaaaacagtctttcaggaaaacagcctgccggaagatataccggccataaactggaaaggtgaaaaaacgatagcgatgattgatctgctcgtcaagctaaagctcctctcttcgaagagcgaggcgcgccgcatgattcaaaacggcggtgtacgcatcgacggagagaaagtaacagatgttcacgccaaagcagagataagagagaatatgatcatccaagtcggcaaacgcaagtttttaaagctccaatagtctgatattccgaaacgcttatgacccttcattcataagcgtttttttgcaggtataaagcagtcttttcaaaaacgctctccatcttgcaggaaactcctttagcatcccgaaatattccccaaccatacatttaggggaggtttatttttgatgaaaaagcttttgactgtcatgacgatggctgttttaactgccggcacactgctcttgccggcacagagtgtcacccctgccgcgcacgctgtacaaatatcaaatagcgagcgcgagcttccattcaaagcaaagcatgcgtactctaccatttctcagctaagtgaagcaatcggccccagaatagccggaactgcagctgaaaaaaagagtgccctattgatcgcctcatcaatgagaaaattaaagcttgatgtgaaggttcaacgattcaacattcctgaccggcttgagggaacactgtcttcagcaggacgcgatattcttctccaagcggcatccggctcagctccgactgaagagaaaggactgacggccccgctttacaatgcgggattgggctatcaaaaggactttaccgctgacgtcaagggcaaaatcgccttgatttccagaggagacctgacttattacgagaaagccaaaaatgccgaagccgccggagcgaaagctgtcatcatttataacaacaaagaaagcctcgtgcctatgacgccaaacctgtcgggaaataaagtcggtattccggtcgtcggcattatgaaagaagacggcgaagcacttacccagcaaaaagaagccaccttaaaactaaaagcattcacaaaccaaacctcccagaatatcatcggaatcaaaaaaccaaagaacatcaaacatccagacattgtgtacgtgacggcccattacgacagtgttcctttttcgcccggagcaaatgacaacggctcaggtacctctgttatgctggagatggcgcgtgtcttaaaaagcgttccatctgataaagaaatccgctttatcgctttcggcgccgaagagctcggcctgctcggctcctctcactatgtagatcatctatcggaaaaagagctgaaacgaagtgaagtgaacttcaacttagacatggtaggcacaagctgggaaaaagcgtctgagctgtatgtcaacacattggatggccaatctaactatgtttgggaatccagtcatacggctgctgaaaaaattggatttgacagcctgtctctgacacagggaggatcatctgatcatgtgccattccacgaagccggcattgattccgccaactttatttggggagacccggaaacagaagaagttgagccgtggtatcatacccctgaagactcgatcgaacatatcagcaaagaacgcctccagcaagcaggcgatcttgtgacagccgctgtctatgaggctgtgaaaaaagagaagaaaccgaaaaccattaagaaacaaatgaaggcgaaagcatctgacatttttgaagatatcaaataaaaaaagacggcacttgggtgccgtcttttttttataatgatcagctgtttagccgtctataagtaaagctttcagtttatcaactgtattttctttttctaacgggcgataaatggtcagtttcaaatcaggagagtcatatatttgtaatgtcatatgctccatcaccattgttccggctgccgggtgatgaagtactttttctcctgcgtgtgtgcctaatacttcgtggtggttccaccattttttaaattccgggcttctttcagttaactcatcgatcagctcttttatccatgcttccccaagaaaccggctggctgtcgatcgaaactgtgcgataagttttttggcgtggctttcccagtcgtcaagcagatcccgatactccttcgaggtgaaacatcgccatatggcattcctttccttactgcccatttggccaaaattgccgaacacagcacaagctgctgtgttccaagcaataacgtcccacttttcgtcagtcacataaacagggcaattggttaaatgatcaataaagtgccgcacagccagaggaaggctcttattatcttcatcctgatcatctaaaggaacatgatggccagccaacagaaagacatgacgcttttcctcataattcaatttgagcactctcgatatgctttccagtacctgtgttgatacccgaatatcccttccctgctccagccatgtgtaccatgtgacacctataccggacagctgggctaattcctctcttctcaagcctgttgttttccttctggtacccataggcaatccaaactcttgcggagaaagctgtgcccttttcagttttaaaaactcccctagctctttccgtttttctgccatactgtccacatacacactctccttttgcatagaatttcctattagtattctacataaaaaggagaaggtttttatattatttgtttcgttctccaaatacttcagcggccacaggaagaatggtattcagtgcattcggaaaacctgagtaaataatcatctgcatcatgacttctatgagttcttcttgtgtccatccgacattcagggctccgttaatatagaattttagctgctgggtattgcccaatgcagtcaatccagcaacggttgctaataatctggatttcagatcaagacctggtcttgaaaaaatctgaccgtagttaaactccacggcaagcacaccaaggtccggagcgatggaatgtttaaaattgtccacgatcgcttcatagttctcctcatcaatttgtttcagaatatctaacccttttttataacgttcacttgttcgcatcagcttctatctcccttccaatatcgcttttttagtagtacggtttatggtaatccttgaactgaaggcaataccgaccatgatcatccccaggatacaaacaccgttccaatgaaacagcatccagaccgcaccccctgcatacgatcccaaggcgccgcctaaaaacgtgctgaccataaagaggccattcaatctgctcctcatttcagccgacaattggaaaatctccgcctgacacgccacctgattcgcctgaatgcccatggtgatgaataaagcgcccaatacaatcacaatcaatgaagtctggcctgccattaataaaacaaatgacaataaggtaaaagacatacaaagcttgttggaaaaagcagctcctttttgatcaataatccggccgatcagcggagttgcaaaagccccgccaattcccaccaaaccgattgttccggcagtctggctgccaaacgagaatggaggttcactcaccataaacactaacgtcgtccaaaataaactgaaggcgccgaacatgaagccttggtttacacatgcttttcttaacactttctccttgatcaaaagcggaaataatgaagaaatgagttttccgtaatgaaatgcatgtgtccctttgcttttcggaaagcagaagtgaatgatcaacataatgatgacggctgctgcacaggcaatccaatacatcacgcgccagccataatgggcatctatcgccccgctgaccactctcgcccctaaaattccgcaaaccaagccgatagctacgtttccgagtacttttcctctgttcctgtcatttgctaaacctgccgcaaacggcacaaggatttgaggaataatcgtgaagaatcccaataataaatttgtgatgactagccatggaaagcttacagctaacgctgaagctgccgaacaaacccccactaagaatagcaggctcacaattaagcggcggcgttcaaaaagatctcccaatggaacaagcagaaggttccccgccgcatagccaatctgcgccaatgtagcaatcattccagcttgtgccggcgtcatatgaaacgtgcctgccatgctgacaagcaatgtttgattgatatagacattggctaccgtaaacccgctagtcaccgcgataagaaaaatcaaacctctcgataatgaaatggaatggttcatgtttacctcctttcttcatgcatgataaagcaggttcaatcatggaaacagaagtgagtttatactggtataaaaagtactagcaagcaaagcaaaaaagcgaaaccctgtcaggcttcgcttttgttatcaatccacttctttcttaatccccagcattttctcatctaggtaatgggcaatctccgcggcttccttcagctcatctgttaattgcttaggaacgtcattgttcaatttatagtaaattttatgttcaaggctcgcccagaaatccatcgcgattgtccggatttgaatttctgctttgacgtattccacacggttcgttaaattcacaggcatctcaatgattaaatgcaggcttcgatagccattcggtttgggtgtctggatataatcctttacctttacgattctcaaatcttcatgctgcttcaacacattcacgacattataaatgtcagaaataaaggaacagatgatgcgcacgccggcaatgtcgtgaatatgctccttcatttccttcgtcgtaatctcacagccctttctcattaacttattcacgatgctttcaaagcttttgacacgggattttgtatgttcaatcgggttgtgtccgtgaatgaggttatattcctggctgataattgagaactttgtatcgagcgcatctagcgcaaatttataaactaataattcatttttccaatcttccattactgtttttaaatcgtccatatgtgttacagataaatccattttcgtcatctcctttaacggaactttatccgctgtccatgtactagacgtccctgtctgctgcaaggttctatgaatttttttacaaaatgcggtcgattgtaacaaaaaaagaccgcacgaaacgagcggtcttttttattatcggaaatagctgatcaataatccgatcgagagcaggaatccgaaaaatgtatttgtttgggctgttgatttcattgcgacaatcatattcatcggcatttcgttctggacgaaacccttcactgcctgaaccggcttaggcacgctcaaaaagacgacaaacagccatgggcttgcggcaccggtaataaccaagccgacaacccagatataagcgacggcaaacgacgcagctaacagagtaacagctcccttatgccccatcaaaatcgccaatgttttgcgtccgccttttttgtcctcttcaatatcacgaatgttgttcgacaggttaatcgcgccgacaagaatcgcaatcgggatggaaatcaaaatgctttgcgtgttgatcatatctgtctgaatgaaaaacgaaatcagcacaaacaccgaacccatgcaaatgcctgagaataattcaccgaacggcgtgtacgcaatcggcagcggcccgcctgtatacaggtagccgatcgccatgccgacaaggccgatcagtgcaagccaccagctgctgcttgcacaaatatagacaccgagcaaaatggcaatcccgtatgaggcaagagctaattgcaaaatcgttttaggcttcattccgtggcgtacaattgcccctccgattccgactgattctgctgtatctaatccgcgtttaaaatcatagtattcattaaataagttcgtcgcgatctggatccataggcaagaaaacagcatagccaaaaacagcagcagatcaaccttcacataaaacatcgccaaaacggttccgagcagcacaggcacaaacgatgcggttaacgtatgaggacgggttaactgccaaaggatctgccccatgctttctttttgcggcgctgtctgaccctcacccttatttgtttggttcatcttcctcttcctttctattaaaaggcttactttttttcagccggcagcttaataaaaaactccttttgcttccttatctatcataatgacttctcccttatttcacaagataccgcaagaaggcgttttctttcttattatacgcttctcgccctgatttcattaggtttctgctttcacttgaacgaacaggtacagaaaaatttttttaagtacattacactttttaaaagttaaaaagatcttttgactccagctatcttttcctttattatgaatcagctcgaaacattccattcttgcccttgcaggtataaagattcattttcaaaaacatacgccgatatattaatttgagggagattagggaaaaaatgaaactttttgagcatctgatcgtcaaataatcatgtgattgtcgaaaaaacgggaagggaatttttgatatgctgcaattaatgaaacagctgtatgaaaaacccgctgtcaagtggacatgtcatacaggcttttatttgatgatactgcttgttttgttttttatgtatggttttcacaccgcgaataccggttcatatatttataacgatttctaattggagagagaataactatgaaacttttacatgctattcaaacacatgcggaaacttatccgcaaaccgatgccttccgctctcaaggccagtcgctcacgtatcaggaattatgggagcagtctgaccgcgcggctgccgcgatccaaaaacgcatttctggggaaaagaaatctcctatccttgtgtacggccacatggagccgcacatgcttgtttccttcttgggaagtgtcaaagcgggacatccttatattccggttgacctgtccattccgtccgaacggattgcgaaaattatcgaaagctctggagcagaattgctgatccatgcagcaggactctcaattgatgcagtcggccagcagattcagacagtttctgcggaagaactgctggaaaacgaaggcggctctgtcagccaagatcaatgggtcaaagaacacgaaacgttttatatcatttacacttccggaagcacaggaaatccgaaaggcgtgcagatttccgctgcgaaccttcaaagcttcacagactggatttgtgcagactttccagtcagcggaggaaaaatatttttaaaccaagcaccgttctcatttgatttgtctgtcatggacctatatccgtgccttcaatcaggcgggactttacattgcgtgacaaaggatgctgtgaacaagccgaaagtcttatttgaagagctgaagaagtccgggctgaatgtgtggacatcaacaccttcctttgtgcaaatgtgcctgatggatccaggtttttcacaggatctgctgcctcatgcggacacatttatgttttgcggagaggttcttccggtttctgtggcaaaagcgctgcttgagcgttttccgaaagcgaagatttttaatacgtacggcccgactgaagcgacagtggctgtcacatcggttgaaattacggctgacgtcatcagccgcagcgaatcgcttccagtgggcttcgccaaaccagatatgaacattttcattatggatgaacagggacagccgcttcctgatggagaaaaaggagaaatcgtcattgcagggccgagtgtaagccgaggctaccttggtgagccagagctgacggaaaaagcgtttttctctcatgaaggccagtgggcataccgaactggcgatgccggctttattcaagacggtcagattttctgccaaggacgtttggattttcagattaaacttcacggctatcggatggagctggaggaaatcgagttccatgtcagacagtcacagtacgttcgctctgctgtcgtgattccttatcagccaaacggaacagttgagtacctgatcgctgctattgtgcctgaggagcatgagttcgagaaggaattccagctgacaagcgctattaaaaaagagcttgccgcttctcttccggcatatatgatcccgagaaaatttatctatcaggatcacattcaaatgacggctaacggcaaaattgaccgaaaacgcattggcgaagaggttcttgtatgacgccttacagctcgtttttattctttatactgcttggcattcttcttctgccgacgatcattctcggcttaaacggaaaaagatttcaagcatacaacatgttcatatctatcattatattggctttaattttttcgcatgacttacacggggtcatcgcgctgtgcctgtttacaatatggcaggtgctcctgatcagcggctatctggcataccggcagaaagcgaacagcggctttgtcttttgcggggctgttatcgcgtctattctgcctttatttctgtcaaaaatatggccgtttctttcacacccgcagccgcatcatccgccgcataacctgatcagctttttagggatttcatatttaacctttaaaggcgttcagctgattatggaagcaagagacggactgctgaaagaacagctgccattgcaccgcctgctgtatttcatcctgtttttcccgacgatttcctccggcccgatcgacagataccgccggttcgtcaaggatgaacagaaggcttggacgaaagaagaatacgccgacctgttgtatacgggaatccataaaatcttcatcggtttcctgtataaatttattatcggctacgcgatcaatacgtacttcatcatgaatcttcccgcaatcacgcacaataagattcttgggaacctgctgtacatgtacggctacagcatgtatttattctttgatttcgccggctacacgatgtttgccgtcggggtcagctacattatgggcattaaatcaccagaaaactttaataaaccatttatcagtaaaaatattaaagatttctggaatcgctggcatatgtctctgtcattttggttcagagattatgtgtttatgagattcgtattttggatgactaagaaaaagtggatcaaaaaccgtatggccgtctcaaacatcgggtatttcctgctgtttatgctgatgggggtttggcacgggctcgcgccgcaatatatcatttacggcctctatcacgccgtgctgatgacgtgttacaactttttcgagaagtggaataagaaatataaatggctgccgtccaaccgctggacaaccattctcgctattgtgatcacattccatttcgtttgcttcgggttttacattttctcaggaaaaccatttcatcaccaccattaaaggagattagaaagctatggattttaaacaagaggtattagacgttttagcagaggtttgccaggatgacatcgtaaaggaaaatcctgatattgaaatttttgaagaaggtttgcttgattcttttggaacagtagaattgctgcttgcgattgaaaaccgttttggtattttagtgccgatcactgaatttgaccgggacgtttggaatacacctaacaacattgtaaatcagctgtctgagttgaaataatgaaaaagcgttttttcggtccaattattttggcgtttattctattcgcaggcgccatcgcaattccatcttcatggctgacaggcttcatcaccgataagcgtgtgaaagagtcagcaacagccttgaatccgagtatgtttcaagggctatatttacaagatcagatgctcaaagatccgacatatcttccgatttacgggtcttctgagctttctcggctggacgagttccacccatctaattattttcaggtaaacaatgagggattcacgccataccttgtcggcaaaggcggatcccagtcattgattcattctttaaacttcgctgcccatatggatcagctgaagggcaaaaaaatcgtattcatcgtgtctccgcaatggtttattaagcgcgggtctgatgaacagcatttcgcgccgaactattctgcgctgcaagggcttgatttggcatttaacgatcagatcgatcctgaaattaaaaagaaaatgatgaaacgcatgctgcgctttaaggctgtgcaaaacgatgccattctttctgagctgtacaaagcaatggtaaacggccagacgtggaaagtgaacgcgctgaagccggcggcgaaagtgtattacagcatgctggaaaagaaagatctgtattattcaacgacagaatcatccgggccaaagcgctatatctcgcagtcagtaaaggataagtcatggtctgaattgaataaactggcggatcaatcgggcaaacgccactccggttctaacgattttcacatcgacaaccctgtctataaaaagctgaagccgaaagtgcctaagctgaaagggaaaaacaaaggaagatcgtatgcggtgtcaccggaatatggcgactttgaaatgatgctcgatatcctgaaggatgcgggcgcagagcctatgtttgtcaccattcctgttaacgggaaatggtacgattacacgggcttcccgaaaaaaggacgcactgactattacaaaaaggtaaataaacaaatcagagcgaagggcttccaggttgctgatttctcagggcatgaatatgacccgtatttcatgaaagacaccattcacatcggctggaaaggctgggtgtatgtcgataaagcaattgacgaattttataaaaccggaaaagtcacttcatcctgagcatctcataggacgcggctgcatatttcctgctaagatttgaaatagtaaagaaatcacagccaacttaattaagaggtgttacatccaatgaagatgacaggcaatacggttttaatcacagggggttctgctggcatcgggcttgaactggccaagcgcctgctggaacttggcaatgaagttatcatttgcggacgcagcgaagcacgtcttgcagaagcgaagcagcagctcccaaacatccatacaaagcaatgtgatgttgcagaccgttcgcagcgggaagcattgtatgaatgggctttaaaggaatatccgaacttgaatgttctcgtcaacaacgccggcattcaaaaggaaattgactttaaaaaagggacagaggatctttttgtggacggtgatgaaattgaacttaatttccaagcgcctgtccatttatccgcccttttcacacctcatttgatgaagcagcctgaagcggcaatcgttcaggtcacatccgggcttgcgtttaacccgttagctgtttatccggtgtactgcgcaacaaaagcggcacttcactcgttctcgcttacgctcagacaccagctccgcgacacgagcgtggaagtgattgaaatggcaccgcctatggtggacacgggcttaaaccaaaaatcacgcgataaacaaggcctgacgtaccggggcatttcatctgaagaatatgttcaatatttcttggacggcttgaaggaaggcaaacaggagattacaaatgaacgggttgaaggtcttcgggatgccactcgcgccgattatgacaggttattcaagcaaatgaacacgcaggagaattaatttctcctgcttttttcatatgaatttcttacaaatttgagcaaacctattgcgattatttgttgaaggtatacaatagaatataattattttcaaataagtttgataatataaacaatttaacagcagggagattgaccatgactaaacaaacaattcgcgttgaattgacatcaacaaaaaaaccgaaaccagacccaaatcagctttcgttcggaagagtgtttacagaccacatgtttgtaatggactatgccgcagataaaggttggtacgatccaagaatcattccttatcagcccttatcaatggatccggccgcaatggtctatcactacggccaaaccgtgtttgaagggttaaaggcttacgtgtcagaggatgaccatgttctgcttttcagaccggaaaaaaatatggaacgcttgaatcaatcaaacgaccgcctctgcatcccgcaaattgatgaagaacaggttcttgaaggcttaaagcagcttgtcgcaattgataaagactggattccaaatgcggagggcacgtccctatacatccgtccgttcatcatcgcaaccgagcctttccttggtgttgcggcatctcatacgtataagctcttgatcattctttctccggtcggctcttattacaaagaaggcattaagccggtcaaaatcgctgttgaaagtgaatttgtccgtgcggtaaaaggcggaacaggaaatgccaaaaccgcaggaaactatgcttcaagcttaaaagcgcagcaggtcgccgaagagaaaggattttcccaagtgctttggctggacggcattgagaagaaatacatcgaagaagttggaagcatgaacatcttcttcaaaatcaacggtgaaatcgtaacgccgatgctgaacggaagcatcctggaaggcattacgcgcaattcagtcatcgccttgcttaagcattggggctttcaagtttcagaacggaaaattgcgatcgatgaggtcatccaagcccataaagatggcatcctggaagaagccttcggaacaggtacagcagctgttatttccccagttggcgagctgatctggcaggatgaaacactttcgatcaacaacggtgaaacaggggaaatcgcaaaaaaactatatgacacgattacaggcattcaaaaaggcgctgtcgcagacgaattcggatggacgaccgaagtcgcagcgctgactgaaagcaagtaagaaaaagccggcccagtacaggccggctttttttacgcttcaattttgttgaaaaactgcggcagatacgctttgtgcgcctccagcatttcatctaaaatctgtttggccacagtatcggacgggacaagagggttaatcgtcatggcaaggagcgcagtttgatagtcacctgtaactgccgcttctgccgcgacacgttcaaaggatttgatttgctggacaaggccgcggacagacaccggcaagtcgccgacagcaattggcttagggccagttttcgtcatcacacagttcacttcaactgcggaatcgtctggaatactcgctattgcaccgttattgatcgtgttcaccggctgaatgtcgtgtttatcattgtaaatcgagctgattaagttacatgctgcatcactgtagtaagctccgccccgtttttccagctgcggcggtttgatcgcaaggtttggatctttataaagctcgaacagctctttttcgaccttctgtacgacttcagcgcgggtgccctccatttgtgatgcttccagttcgtgctccagcatctcttttgttttgaaatagtaacggtgatagccgcaagggatgacattgagcgcttttaagaaatccggttcccattcggcgcctgagatatttttcatcgtcatcgcgtttttcgggtcgcccatcgcctcgatgacttgctccttcacacttacgccatccaagaaaacatccagcccaaataccatatggttcagtccggcgaattggacttctacgcggtccacatctacatcaagcgctttggctacgcccattttgatgccgattggaacattacagagaccgacgactttcttcaggttggagtagcgaagcaaggcttctgttaccatgccggcagggtttgtgaagttaacaagccaagcgttcgggcaaagctcttctatgtcctttgcgatctcaaggatgaccggaattgtgcgcaatcctttaaacaggcctcccgggccgtttgtttcctggccaatcactccgtattttagcggaatgcgctcatcctttgctcttgcctgcaaaagtccgacacggaattgggtcgtgacaaagtctgcgtctttcagcgcttttctccggtcgagcgtaagatgaatgtcgatcgggacgccagctttttcaaccatccgtttggcgagtgtgccgacaatattcagcttttcttcgccctcggggatatcgacgagccataattcgcgcacaggcagctcatcataccgtttaataaacccttccactagctcgggcgtatagcttgaacctccgccaatcgttacaatcttcaatccttttgtcatatgcttgctcccctttgctcggtgattttttcatataactcaatgatctctgcagccatatccttcactgtcattgcattcattaaatgatcctgtgcatgaaccatcagaagcgtcatttccgtcttttctccgctcgcttcattttggatcagctctgtctgataatgatgggcttttgacaattcttcagcagcgtcttgaagctttttccgcgcttcttctgcgtcaccgcttttcgcagcggcaatggcctccattgcggagctcctaccgtttcctccgtgaaggatgatttgaaaaatgatttgttccatttcctcattcacgcgattcacttcctttctctacagagccgcttctttgtcatctgatgctgcaggcgtttggaccagctccagatcgttttcttctttcagcttctgcttatcccacattctgaagaatggatagtagacaacaaaggacacggcaatattaatggcttgcatgaccgcacctgagacttttcctcctgtcgccaagtagcctgaaaagatcggcggcatggtccacggcactgcgatacccgccggttttgcgacaaggccggtgctcattccgatgtacgtaagtgtcactgtgacaagcggtgtgatgataaacggaagtaagagcattgggttcatgacgatcggcattccgaatataatcggttcgttaatattgaagatggccggtccgaccgcaagcttcccgagctgcttcatttgtttgcttcgggcgcgcaggaacatcgtgacaaccagtgccaatgtggcgccgcttccgccgatattgacccagatatcgaaaaattgctgggtgaaaatcttaggaagctcctcaccggcttggaaggcgatccggttggcatccattgcgccgtaccaaatcggtgccatgacgccgccgacaatgtttgcaccgtgaaggccgcaggcccataaaagcattttgacggcttcggcgacaaggcttcctccaaggcttcctcccagaatggaaagcggagtccccaataaaacgcttacaatattatgaaggctttcaaacggtgtcgcttcaacaatcagccgggctgcccaaatcaggaagatgacggcaaagccggggattaacgcgacaaatgacttgcttaccgccggcggaacaccgtccggcattttgaagactaaattgcgctggataatgaggcggtaaatctctgtggacaccattgcgataatcatggcgacaaacaggcctttgcttcccatgagcgaaagcggaatcccgccgccaaccatgatttctttcgtcgcgccatccggcataaacggcacttgataaggtgttgctaataaaaatgccgcaagggaaatggctccggccgacaaggcatcaacgccgtatttctcggcgagccggtaggcgatgccgaacgcggcgacaagacccataatttcaaaggtcgcgtcgactgggtaggccagtttttcagaccaggagctgccaaacgtttttgccataaactcagcgtatcccgggatcgggaggttgccaatgatgaggaaaaaggaaccgatgataatcaggggcatcgtgaggataataccatcacgcagcgcctgcaaatgacgctgtcccgcaattcttcccgctataggcatgaccttttcttctaagatctgattgactttattcacatagcccgcccctctctatgacacatgtccaagctgttcagctgatttcagcacttccgccccgttgcacgtgccataatggacggtattaatgacgtctaccggaaccccctttgactctcctaattttttgagctgcggaagcatgtaacggacttgcggaccgagaagcaatacatccgctttatcgatatgattttgtacagaatcgcctgaaactgcccaaatggtatagtcttttccctgttcctgcgcacttttttccatcttgctcaccagtaaactagtagacatgcctgctgcacaaacgagtaatatattcatgtaaaagaccccctagagtttgatcaattttgtaatgtcctgctgttgctatcatcatattatgaaatcgctttcataaacactcagggtttttccgcaggcaacggaaaaaaggtatatacaggctgtcagctcagcattttttggtcaaacacatccgaaagctcttgaaatgaacggcatttgaccagctggttcaccgccgccgggtcatccaaaatgctgccaagcagtttatacatgctttgcaagtccgctttgttctccttttcgacacaaagcagacagacaaattgaactcgctgactctcccaatcgatcggttttttgagcgtacaaacggcccaaaacgttgttttcgtctgcggaacaagcgggtgcgggatggcaacaagattgccaaaacacgttggcgacatgtcttctctttcaaaaatggaatctatgatttcttcatcggcaaagccgcattcgaccgctttctgccctaaaaattgaatcacttcttcttttgagcgcagatcctcctgaaaaaaaacgagttctttttttaggtagcgattggctttttccttttcatcactcagaatagattctatttttgtaaagtcagttccgcctaagatggtgttaaccttcagtactggtacagggagctcttttttaatcggaatggtactgatgacaaaatcaattgattcgtaggacatttgatcaagactataatactcagccgttccaagaatatcgagccgcttgccgaaatgggaacgcagtttttcgcgcagaagctgggcgcttccggcacccgatgcgcatacaatgatacagcgtttcggcggactttctgttttttttcgttcaatcgcggcgccaaagtggagagccaaatatccaatttcgttttcatgaatctcaatacccgtttgttcctttatcacgattccggcaatgatcccggcttcaaaagcgagtggataatgttccttgatcgctgccagcatcggatttcgaagattcatgccgtatcggttgcggctgatcgccggcttcatatgcagggccaagccgattttcagctctttgtcatgcaggatgccaagcttcagttcacgatcaacagctttgatcatggcaagtgtcagctgatcggtttcctcttctattgaaaatgtgtcctctccgcattgtgattgtgtcattcgttttgtgccaaggagatgcatggtgatgtaggccgtctcgtctttcggaaacgtaacggcaagctttgattccagctcttttacgatggcttctgcagcctggtactccttttgatgcaggatatgatccatatctttcgggaaaagagaaacatagttttccgttctgatccgtttacaggcgatagcgatatggataatgaggttattcagtcccatgttggacagagggatgcggtcgtttttcatttttttcaagatggcggaacggatgatctcaatttcttcttttggcaaaatatcagccttttcatttaaaacatctatctccgtttctctttcatcaacaatgtactccgccatgcagtacctcatctgcacctcgtccccgcgcagcttgaagccgtaattcggacgtgtttccatgacgatgcggtaaggcagcagacgtttctttacttcctttaaatccgtttggagtgtagattttgagataaatagttcttcagcaagttcatcgagcttgagataatggtccgccagcagcagacgtttcataagataggccattctctcctccggcaataccggcaggccctttttttgctgaaattcatcttgcagcagtgttctgaatacttgctcgtcatcaatgcggagcttgtagccggagcctcttacagattgtacaaaggcaccgtggccgcttagcacaccttgaagttcctttatatcattgcggactgtccgcgtcgttacgtttaattgcgcggcaaaaaacgaacttgtcaccggggcttcagccgccatcagcaagcgcagaatatcacgtagtcgcccatgaagcatgagaaaaacctcctaactagtagatgcagggattcagtgaataggcagaaaggatgatgaagggatgcgaaatgtatataaattctataatggagagaatggcaagtcaatgaacatccggaggactagagggaaaactgacctataaaaaaacagccgggatcagccggctgttctagatgcggacatattcttttgtttagacgccttgcggtccttcatgatttttcgaacaatcgggtaaatgaccggcgcccatttgataacggttttgatcatctttttcaaagctccgattctcccttcttttttctcaaccattcccctgattgcctcttccttaaacatgctaacgcgacacgtacctgtttcccgtcacccagaaacgccatggataatcgcgtgcctccccgctgttgtcaatgccgatgcgcgggccggttgaaattgcttccggtgtgtacccgctttcgatgtaaagcggctgttccgtgatccagcgtccgtagtcattcatcgtgacgccaagcgctttcgtcagctttcctggtccgtttgtccattccctcggactcctgcccggccttctctcctccattaacagctggccttcatgcggctcaatcgccctgattaatactgcttgcgggacatcctcttccgccgcaacgacattcagcaatgtatgggtgtgcatcacgtatgtatatacccgcccagcttctgcaaacatgatctcagtccgcttcgtccggcggttgttaaagctgtgggccgctctgtctccagcccccatataggcctctgtttccacaatatagcctgacgctgtgccttcgtctgtttcttttacaagaaggcagcccagaagcgatggggcaagctcaagagcggttttttgataaaacgtgatgggcagcggatttttttctctcgtcacgaatcgacctctccttttaccgatttttgtacattgtaccattcccgaagcagatcaaaaaaaacggctgttttaaaatctttccattcagggaatattgttaccgttcaaaaaaggagggccaaccattgaaagatgatcatcaaaacaagcagcaccaatcaaatgcccaagggagcgaggaagcgttttctcataagacatccgggaaaaacgagtcagaggataccttaacgaataggcaggggcatcctgttactgacaaccagaatgtgagaaccgtcgggaatagagggcctacaacacttgagaactatgattttctcgaaaagatcagccacttcgaccgggaacgcatcccagagcgggttgttcatgccaggggagcaggtgcacatggatattttgaagcgtacggaagcttcggagacgaaccgatttcaacatacacaagggccaagctctttcaggaaaaaggcaagaaaacaccggcatttgtccgtttttcaactgtgaatcatggaaaacactcgcctgaaacattgagagacccgcgcggttttgctgtaaagctatatacagaagacggaaactgggatttggtcggaaacaacctgaaaatcttttttatccgcgacccgctgaaatttccggatcttgtacacgcatttcagcctgatccagtgacaaacatccaggatggtgaacgtatcttcgatttcatttctcaatctcctgaagcgacacacatgatcaccttcttgttttcgccttggggcattccggccaactaccggcaaatgcagggttcaggcgtacatgcctataaatgggtgaatgaggagggcaaggccgttctcgtgaaataccattttgaaccgaagcagggcatccgcaacctgacacagaaggaagcagaagagattcaagggaaaaactttaaccatgccacacaggatttatatgacgcgattgaaaatggcgattatccagagtgggaagtgtatgcacaaatcatgagcgatgatgagcatcctgaactggactttgatcctcttgatccgacaaaactgtggtataaagacgattttccatggaaaccgatcggcaaattggttctgaacaaaaatccggaaaactaccatgcggaagtggagcaagcttcatttggaacgggggtgcttgtcgacgggcttgatttttcagacgacaaattgctccaggggcgtacgtttgcctactctgatacgcagcgctaccgtgtaggcgcaaattacctgcagcttccgatcaactcgccgaaaaagtatgtcgccaccaaccaggaaggcgggcaaatgcaatatcgggtcgatagagcagaaggacaaaacccgcacgtcaactatgagccatccattatgggcgggctgaaggaagcgaagcaggacggaaaagaccatacgccgcatgtcgaaggcgatgtaaagcgtgaagcgattgacagaacaaacaacttcggacaggctggagaaacgtaccggagatttactgaatttgagcggaacgaattgattacgaatttggtgaatacgctttctacgtgccgaaaagaaattcaggatcaaatgattgagaatttcacaaaagctgatcctgactacggaaaacgcgtagcagaagggctaaaaaaggtttccgaaaacaacagcaacgggccgatcggcacaactgaaacggaacaggctgcaaagcaggctgaacaggagagccatccatctaatccgtattaacaacagcgaacagggctttttttgaagccctgtttttttatttttctattgaaacgttttcaacaattgtgttgtactggaaggaaaggggtggagagatacgatggaattacagcaggacttgattcctcagaaaaaaacaatcggcgccttagatcacgccgtttttttatgcatggtattttgtttctggttttcaggctatatttacgttcctgtattcagtctgtatttggaggatctgcacttttcatatggcgcaatcggcatcattctcggcagctacggggtcacgcaaatccttctgcgattcccgctcggccttgtgtcagacatcctgttttccttgcgcaagcaattgttaattgccgggttcggcttttccgtcctcagcagcctgctttttctgatgtttgattctttcttcttcgtgctggccgcccggcttttcgcgggaatcactgcttctatgtgggtgatggcgaccattttatacgcacattatttcaacaatggcaatgcatcaaaagcaatgggcatcatgcagttttttaccgtcatgcctcagtttgccagcattgtgttctgcgggcttgcggcagcccatttaggcaggcaggttcctttttggatggcgctggcagcctcggtcgccggtctggtgatctgctgctttattaaggatccgtctgctcctcccgcaaaccgtgacaccattcgtgtcaatcagtacatcaaagatacattgcagctgccaaagctgaagcttttcaccatcctgtctatgacggcccatgccgtattatttatcacagtattttgttttacgccgctttacatgaatcagctcggaatgggtgacgcggagcttctttgggtgatgagcgcctttttcctcccacacgcagccgccacattaagctttgtgtttctgcgctttacaagccgtatcgcttactccgtgatgctcattagtttcgctgtcaccggggtctgtttgctatatgttcctttttcagctgcattgttcacggtttgcatcacacacgcctgtatcggactggcgctcggcttcgtttttcctctgttgctaagccatgtcgtcgaaatcagttctgcccgattaaaaatgtcagtgatggggttttatcaatcattttatgcgctaggcatcttcctcgggccccttcttgccggaaaaatcgcacagcttgtcgggcttgcgggagttttttatggagccgggtttctggcatttgccgccttttttgtgatgctcgcgcaaaaacgtaacatgatcaattaatagctttcataccgccggaagcgccacacagaaaacacggccagaagcatgatgcacagaatggagaaagtgagtgaccatccgaaaaaatctgcccgctctccatgaagaaggatatgctccgcctgcttgcaaatctcagccggaagccacttcgcaccatctggaaatagtgaaacagcaaaggaaacggctgctgtgagcccgatcccgcaagccgcagctgctccgacagaccggaatatcgtacttccggcaaggccggcggtcacaataaatatcacccaaagcgcgtaaaggccaaggcttgcggcaaagcggctgaatgatgcgtcctcaaacagcagccggacgtaataataagcaagcccgtatccagctgcaaacgacataatgccgatcacgctttggatgagccatttactcacgatataatgggctgccgtcacaggccgcgacataatcagcgctgttaccccttgatttctttcattggctacactgcccatcacgctaaagatgaccagagccatgccaagcgtgttgaattgagaaagcgtgcttaccatcacttcagacccggagggcatcgtaaaactgattttcatgccgtcaggaaggttccctccatgtgcgatgatttccggcatataataaatggtcagcggctgtgtcagcccgacgatcatcatcgcaatcggcagccaaatcagcttgccgcttttccatccttccagccactccttctgcaaaagcgccatcatcaccttcatgcgtgcaccacctttagatagacgtcttctagagactccgttttctgttcaaatcgggtgacggtcaatccctttcggatacagtcacttaataatgaccggccagcttgtatatcaggcagctcgaaaacagcttgggacggatttttatagacaatagctgagacgtaaggcttctcttcaagccagccttccagcttctctttcactgaaagggtaaaaacgttcgtttgctgctgttgtttcagctcctgtaactcgcctttccatgaaatttcaccatttttcataatcaccacttgatcacacacctgctctgcatcgtgcaaaacatgtgtagaaaacagaacggccatatgctttttcagctcccgcatcatgtccagcacctcgaaccgtcctgtcggatcaagcgcagacaccggttcatccaatatcaaaaacttcggtttatggagcagtgcctgtgccagaccgagtctttgtttcatgcctcctgaatagcccccgatctttttgtgcgccgcttcgtgcaaacccacaaattccagcatctcgccgatttcctcttggcattttctcttcgaaaggccggacagtctccccgcaaatgtcaaaaattcatttgcggtcatccaggaataaaaagctggatactgcgggaggtacccaatcaaacgccgatccggctttttttctcctaacagcttaatgtttccggaggttggcgaaagcagaccggccagcatttgcagagtcgtggttttgccggctccattaggtcctaatagtgcgacacactcattttcattcacgtgaaaactgacattctttacagcttcatgatgcctgtacgatttgcataatgattcaatagacagcatatcggcttacctttgctttctgccgacggtaaaaaacaaaatcggcccaataatattgatacatacaatgattgcagcccacatccactttggcccgtttgtccgctcttcttttatacagctgataagggcaaacaccgccaaagccagctgtaatacaatcagcggcaaaatcatttcccaagaaatattcattgcttgatcccccttttcttccgatccggcctaatgacaaaaaagtaataacaaatcagaggcatcggtgcttgaatcaatccgacaatcccccaaacccatgccatgcgattacgttttttcgcatcaataaataaaaagattccctgcgccaatacgatgagacaagccgcaaccgttatgataatttctgtttgtgtcatccgcgtttcacctcgcattcgccgagatgcctttttttctcagccgcaatcaaaatcggcagcaccgcaagcacacaaacctgaagcacaataaacacagcaggagcttgagtgaaagctaagattgcagcactcacaaccatcagcgcgcagaatacaaataaaatgatctcttgaagaagtttttttctgtattcagctttcatttgtgacagctggtgaagcagttctttttgattcggtatagagggattggctgtttgatcaatttttttccattctgactttaaatgatcagaaagcttttctttattcatcgtcccactcctttctgatttgctggagccctttatgaactctggactttacagtgccttctttgatttgaagcatcaccccgatttcagcgtaggtatagccgtagtaatgccttaataaaaccggtgtgcgcagtttagggtccagctttgaaaacagatcgagcgtttcgctccactctgcccctttcgccgacacgtcccacttgatcttgcggattgtttcctccgtaactgtctgattccgtttccattctctctttctctttttctgatgatcgagatagagccgcgatgcaatggagatcagccatgtggagaattttgaacggccctgaaagcttcttaaatggatgtaccctttcagaaaggtttcctgaacaagttcctcgctgagatcggggtgaagggaaagctttaacaagtatttatataagaaagaatagtgatagtggaaaagggctgtaaacgcctcgtcgtttccctctttcgcctgctggatcagccgctgttcttcatgtgtatccaatgaccgtgatccccccttttttgtttttctgccttatgagacgacaccggattcaaaagcgttcatcttttttacaattcttttcagccattgacagatcaggcttcccggccgtttggctgcatatccttatttgtaaacccccttatagtctgttaagctatgactttatgtcgatttcaaaaaaacatccaatatggaggacgatgcattgaaagtagaaaggcgaacgattgaatatattccgaatgaagaaagacatggtaaagcgaaagatttatttcccgtatggttcggggctaatatgcatatcaccacgttagtgaccggcacgattcccgttgcaatgggacttaatctgttttggagtgttgccgctattatttgcggaaccttaatcggtgccatatttatggcgtctcattccgcgcaaggccctcagctaggcatcccgcaaatgattcaaagccgtgcccaattcggcgtaatcggagcgattcttcccctcttcttagtcatgtttatctaccttggtttcttcgcaagcagcacgattctggcggccggaaccttaagcagctttgttcccatcccgggatcatggagcattataggcttaagcgccttatgttttttactcaccattttcggccatgatttgattcacaaaatgcaaaaaatcctttcttggacctcttttgctgtattttttgctgcaacgattctcatttttcaattgccgattccggcaggcagctggattcccggagcgattgatctgccaattttcttggtggcagtcagcgcagttgcgacgtggcagcttgcctacgcgccatatgttgccgattattcaagatatctgccagttaaaacaccggcttcaaaaacattttggtacagctatgcaggtacatctgtcagctccatctggatgatgctgctcggcgcattgctgacaacctcacttcctgactttacggcaaactcaggcagccagattgtccaattgttcggtcccttctcgtttattatgctgatcattgtgttatttgggcaaatggcgatcaatgtttttaacctgtatggggctttcatgtccacgacaacaacgctggagccatttctgaaattaaaagtcacgcccaaagtcagaatcatcatgatcctgggtgtcacgcttgtcggcacagtcttaagcctactgggacagagcaattttatggagctgtttttgaattttatctttttcatcagttatttcttaattccgtggacggcaatcaatttagtcgattactacttcgtccgccacggaaagtatcaagtcaaagccatgttcgacgtaaacgggccttatggaaaggtcaattggatcaccacaattgcgttcgtgctgtctatcttgctggaaattccgtttatcaatacaagcttttacatcggaccgcttgccaaaatgtttggcggcggagacatcgcatggattatcggcttggccgtgccttctgtgctttactatgcattaatgaaaccgcgtctgaaaaaacgggcggggtatcaagaaaagctgtcttctctctgaagacagcttttttatcattcaaatcgtttccacacgcggggcaggatgtcagatagctcatgagcgagcaacgtatgagcggagtgctcgtccgtccagagctcggcgcacgcaccatgcaaatagaccgcgtttaatatggcgtgctttggatcttcatggcagcagagcatccccaatatcatgcccgtcagcgtgtcaccggttccgcccttggcgagcgccccgtttccagttggattgagccagcagtctccatcaggaaacgcgatgacggtttggtttccttttaacacaatgacagtctgcagctgagccgcccattcctttgcatattccgctctttttttctgcaattcgttcacgggcacccctgtcattcgggaaaactcgcccgggtgcggcgtgaggatgacgggggcctcccgtttcggatatgtgcgcttcgccagcgctccggcatccaaaataacaggacaatcagccgtaagcacatgatcgactgcctgctgtacgctttccgtttgcggaaggcccggtccgatggcaatggcccggtacgtctcttcaagctgagcatccgccgcctttttccagccgtcacgccaataggtcgcctcgggcaaaacaggaacaattagcgggattacgctttctgatgtaccgatgacaagcttgccgagaccgctccgcatggccccaagccctgcaagcagcgctgctcccggcatgtcgtcacttccagccagcagcaaagccgtaccgtacgtgcctttatggctctccgcatctctttcaggaagcgtggcccttacatgctcttccgtccaaaatggaacattcatctctatccctcctctgctttcttttcctatttttcctgtcccttttctttttcaaacaaaaaagacagccttttagggctgtcttttattttacaggaacatcaaggtgatacaggcggcgatatcgttcgtttgccgccagcagctcctcatgggttccttccatttctgttttgccgttttcgagaaatacgattttatcggctgcttccactcccgcgagatggtgtgtaatccataaaatcgtttttcctttcagcacctcaaacaccgtttccatcaattcacgttcggtaataggatcgaggccgactgttggctcatcgaggatgatgatcggtgtatcctgcagcaaaatcctcgcaagtgcgatccgctggcgctctccaccggaaaaacggatgccggtttcttgtacagaggtatgatatccatcaggcaatgactcaatgtagtcatgcagcttgacctgctttgcggcgcggcgcacatcctcgtcgcttgcttctccgtttccgagcctgatgttgttcaaaatacttgtatcaaacaggtgcggtttttgatttaacacggccaccgcatccgcaatctgatcctttaacagcgctgtctccactccgtttaacgtcacagaaccggagtccggtttcaaggcgccttcgattaatgcaagcgatgttgatttcccagagccgcttcggccgagcagcgccattttttctccttggcgcagcgtaaaggaaaagttgtgcagcacttggctgctgttgtcataagaaaacgtcacatcacgaaaggccaaggtgacatcttgaagatcgagcatttgatcccctgattcagtttgtgacgcctccagctgaggagccaccttgttcatgcgtctgatagaatcctgatagcccggcacttcgcctaaggcatccgaaagcggcaaaaaggcttccgtcaacggaaataccactagcacaaaagcggcaatcatcgttttagcgagctcgccgtccgcttgctgtcccgctgtccaaaacagcatcatcaaaataaggccggcgacaaggcattgcgcaacaaagtcccgccatcttgtaaagcattgttttttccgttcaagctcaaaccaatcatgttcctctttttcataagcatcaataaaagcatgccggcgtccgctgaacatccagtcgctgacacccatcacagcatctgtcagacggctgtacagcgcattccgtccgcttttcagcttcgcattcttcgctctcgtcacgagcaaagacacaaccggaaacaatacaacaagaacaaacaaatacagcgcaagcaatatggcaaacggccaagagaagaagccgagcgctatcactgacacagcatacaggagcaaggctgagatcgcaggaaaaatcgtttttaagaatgcatcctgcaaatgctcaatatcctcagacaaaatgccgagcatatcccccgtgcgaaaacgggaacgcagcatcaaagcacccggctcaagcatattgtaaaggcggacgcgcatgtcggatacgattttcaaaatgatgtgatgcccgacaagccgttccacatatcgcgacacagaccgcgcaatcccaaaagtgcgcactgcgacaatcggcacataaatgagcagaatgttttccggccttgtcgccgctttagaaatcaaaaacccagaggtgaacatgagaaaagcagcagaaaaaatcgtcaccgcgcccaaaaagataaccagaacaaacaggcgggcattttgcttgatatacggcaaaatccattcttctttcttcatgctctttcccccagttgtgccttcacgagtttggtatacacaccgtttttctccagcagttcattgtgagtcccgatttccgcaatcctgcccccgtccagcacgataatttcgtccatatcgagcatccagtgaaggcggtgagtcgcgagaaagacgagcttatcctcaaataaatccagcatcgtttcttttatttcatattctgtttcgatatcaagatgggcggtcggctcatccagcagcaggatcggacggtttcccaaaaaggcgcgggccagcgcgacacgctgtgcctggccgccgctgagcgcccggccgccttccccgatccgcccctctaatccttgaggaaggctatccaccagctccgccagtccagctgccgcagcagcacgggctgtatcctctgccgaagcgcttggatggtagaagcgaatgttgttgccaagcgtatcatcaaaaatgtacggatgctgtggaatgtaaagaaggttcttctgccagctgccgtcctgcaaatgggaccggcttgtaccattaacctcaatcatcccgccatccggctctaaaaatccgccaagaatatcaattaatgttgattttccggcgccgcttgcaccgataataccgatttttttcttgcccttgaatgagagatgaatatcagacaccgaacggccgactgacacgcctgacagcttcagctcatcctgatcagaccaagcctcgagctgaagcggcgtctcttctttaaaaccaggctgcgacaaaatctcttgaatggtttttcctgcttcctggccgttcagcgttgcatgataatcattccccacttcccgcaccggcaaaaaatactcaggcgccagaataagcgccgttaaagcagggccaagcaaaatatcgccgtcaatgaggcgcaggcccagaaatactgcgactgtcgccaccgacagcatcgtgaaaaaatcgagggcgaatgatgacaaaaacgccacccggagtgtgctcatcgttgccttgcgataccgctcactcacatagaaaatatttttgctgtgtgacttgctcaaacctaggaaacgcaatgtctccagcccgcgaagagaatcaacaaaatgattggaaagtctctgataggatttccactgacgatccgcttttctctgcgcgacaaggccgaggagaatcataaagatgatcagaatcggcatagcagcgactaaaatgatggctgatgtccgatcctgaaaaaacacataaatgacaactgccgcaggcacaatcgccatgctgaccattttcggcagaaacagctccaggtagcggcggaactggctgatgcctcccatcgccagcgtcaccatttgccccgtcccctctttctttgcaaagcgggggcctaatcggaacagctgatcaagaaaacttttcctcaaatctgctcctgtccgggcggcgtattgatagacgattttctgtcgcgccaccgtcaccccgtgccgggcgataaaagcgatgaggaaaaagccgatcatcggaaaaagggaggtaatgcccttcccgttgaacagtccggttacggcctcactcagccactctgcctgcataataatggcggctgtctgaatcatcgttaaacaagtaatcaaggtgagaatccgcttcattcctttatatcgaaacaggtcttttcccattaataagtcataggctccttatggctgacgcgcttccggaagacataatagctccagatctggctgccgatgacgaacggcaatagcgttaatgctgcaattgacatgactttaagcgaataatctccggaagaagcgttagctactgttaaatcgtatgcgctatgaagcgagctgaccattacgcgagggaatagggaaataaagatcattcccacggtcagcgccagaccagcgcctgtcatcccaaatgtccagccgtcttttttcttacgaataaatacagccgcgagcataaagcagatgacaatcaaaacagcgagcggaatggtaatctcgccgcggcgtgtaaacatgtctgtctgatacgcagaaagggccgcgaaggcaagaaccgctacaaaaacaacacccattatcttttgcgccattttccgggcgcggttttgcaaatcaccaatcgtacgcagcgtgataaacattaatccatgctggaagcaaagaagcgttaccgtcacaccgccaagtatagaatatacattgatataatcagaaacatgtgcgtgaatgttcatgtcggcatcaatcggcatcccgcggaataatgtcgtgaacagcacaccaagcacaaacggaggaatcagactgccgaagaaaacgacccagtcccaaacctttacccattttaaatgatccaccttgccgcggaactcaaacgcgaccccgcggcccattaacgcaagcagcactatgacaaacggaatgtaataaccgctcagcatcgttgcataccagtttgggaatgccgcgaaaatggcgcctgcgccagtcaaaagccacacttcattcgcgtcccagaacggcccgatcgtgttgatcagcactctgcgttctaattcattatggccaagaaaacgggtcgccatgccgaccccgaaatcaaagccttccaaaaagaagaaacctacaaacaatacggcaacgagtataaaccaaagatcatgaagagatgccatggtatacctcctgactaaatggatctgttgatacaggaacatcatgatgatcactatgctccgcaccttttttaatctcacggataaacaagaagacaagcagtgcaccaagaatcaagtacatcacaccgaatgcgatgattgagaataacagggagcccgctgttacattaggcgacacggattgagcggttgtcattaaccccataaccgtccaaggctgacgtccgatttctgtcataatccagcccgcggagttcgcaagaaacgggaaggaaatcaacgcgatcatgatgcgcaaataccatttgctgttttcaagctttttgcggcggtttaaccaaaggccgcctaacgcagcaagaatcataacaacacctgctcctaccatgatgcggaagctccagaatgtcgttttcactggcggaatgtagtcgccttttccgtatattttttcgtactcagcctgaagggttttcatccctttgacacttccgctgaatttctgataagccaagtagctcaaggcataaggaactttgatttcatttgagcttttttcattttttgtatcgatcgtcgcaaaagcggtccaagcagcagggtcaccgctgtcttcccatagaccttcactggcagccattttcatcggctgtgattccatcaagtgctcagcctgcatgtgtccgctaaggccgacgccaagaccggcacaaagaccgacgatcattgcgagtttaaaagattgcttaaagaacggcacttcttttttcttcagcagtttaaaagcactcactccggcaataaagaaagctccagtggcaagcgcaccgaaaataacgtgcgggaattcaacccaaagctgagggtttgtaatcaacgcgccaaaatcattcatttccgcgcggccgtttttgatcgtaaaaccgaccggctcctgcataaaggagtttgctgttaaaatccagaaagatgacatgatcgttccgaatgatacgagccatatgcagagagcgtgaattttcttcggcaggcggtcccagccaaaaatccataatccgataaaaatagattccatgaaaaacgccaataatgcttcaatcgcaagcggagcgccaaatacatctccgacaaaacgggagtaatctgaccagttcagtccaaactggaattcttgcaaaatccccgttacaacaccgactgcgaaatttattaagaataagtgtccccaaaactttgccattttgagatacagttcatttttctttacaagataaagagtctccatcaacgcaaccataaacacaagcccgatagacatcggcacaaacaagaagtgaaacaacgttgttgatgcaaattgtatgcgggctaataccaattcactcatgctttctcctccatttccggttaaaactgttaatttgctcactacttcacaaatagaaccgagactttgatcagtaattcacaaaatagacgaaaaaaatattgttcaatatttcacaaatgtgtcaaaaagtcgtccaatatgagacaagattgccagactgaccaaatgacacaatctctgactggttcatattaagtactttacaacgattcatttcaaaaataaagcctaaaatacctaaaaagtcccgccctatgtgacggatttttgtctattttgttgcttatttatgtcggctgctaggataaatgaccctttattatcgtacatcaacacatcgttccttgcgaacaaaatgcttgccctgcaccagcactcgtttctcagcactccgtcataaacagattttaggcaggatgcctcttttcatttgaaccggcaagtggagaaaagttgaatagtaaatttttaatatattaataatttcaattttttagtatacttaacatagtgaacaatttcactgcatcaagaataggggaggtttttcaatgggagagcttcaaacacacatgcaattgcaaacggatacaattcacgaaggggttcgaaaagagaattggtttgcgaaagccatgaatataaaagtaggcatcataccgcttcctgtgtatgccttgctgtttatattaatcactgtttttgttatgcatcacgatgtaaaaagtgacattttgacatccattgccgtcatggcgtttttcgggtttacctttgcccaaatcggcaaatcgataccgattgttcgttctatcggcggcccggccatcctagctacttttattccgtccgctgtcgtgtactatcacctgctgcctaatgatatcgtcaaatccaccacagaatttacagaaaactcaaactttctatatttgtttatcgccggtattgtcgtcggaagcattctcggcatgaaaagagaaacactcgtaaaagcattcatgaaaatctttattccgcttattgtcggatctgtcacagccgctattgtcggactggctgtcgggacattgctcggactcggatttcagcataccctgctgtacattgtcattccgattatggctggaggagtcggagaaggcgctatcccgctgtccatcggatattctgacatcatgcccatttctcaaggggaagcgtttgcacttgttctgccatcgattatgctgggcagcttgtgcgcgattattctagcgggattgctgaaccgcatcggaaagaaaaaaccggaatggacaggcaacggcaaagtggaccgctccgaagaagagtcccctgcgctggaggaatctcaaagcggacaacaaatgttcaacctttctttatttgcgtcaggcggtatccttgctgtttctttatacttagtcggcatgctcgctcacgattttttcggttttccggcacccgttgccatgctgttactggctgttctaatcaagctgttcagattggtgcctgcctcaattgaaaatggcgcgtttggagtgtcccgctttttttcaacagctgtgacctacccgcttctctttgcgattggggtatccatgacgccgtgggacaagcttgtcgccgcttttaacctcagtaatattattacgattctgtctgtcgttgtgaccatgatggccgttggcttcttcactggaaaatggctgaacatgtatccgattgaaaccgccattatcaatgcgtgccattctggacaaggcggcacgggtgacgttgccattttaagcgccgctgaaaggcttgagttgatgccgttcgcccaggtatctacccgcatcgggggagcgatcacagtatccttaaccttattgctgctgcaccagttttattgatccccgcaagcaagttcttcgtcaaacgaaagagcttgcttttttgcatgtccatatttttgcaagttcccatcccatgctatagtaatagttggaaatactagatagaaaggaatctggcatgcctatgggaactcatctatttctctttatgcttctcgggctgggattttatttgatatcagccctagctgcaaaactcattccggccatagacttctggattgatattgttctatgggtcggcgctgcagtttacatcttctctcatctctcattcatggacggcattgtctcactcgcgacaatgttctactgctattggaccgcaatggatctcattgtttcagagcgtgtggaaaaaccttcgggagactggcaggaaatcgagctggccagaaacaaaacacgtctcctgtcagacattacgctgaccgccattgtgtttgcaggggctgttatttttttcatctatggacctgacccaagccctctcaaatatgtgatccttctcggcatgatctccggcggaggggcactggtgaagcgtatactgaatgttttcagcgtaaaggttttttattcagcagccttagaaaaattgcatatcagctcacactatgaaacccgtacatacccgctttccgatttgaaggacattcagcttgaatcaacagctgatctcttaaagctccatccgcttctgacgatgtattcatcacgtttagatttgacaacaagctttcagcaagtcattaaactgtctcttcccggcgaaacactgtttctgacggtgaaggaaccgcaaaaatggaaaacaattcttcaggaatacacagatgcaaaaaacaatgtggacaatgtgatttctgttttgccgttttatcatagaaaaaatgtgaagcggctgctcgggaagctttattttgccgccagcgtaaaaggggtatccgcttacgccttattggtgctcgcgttatacgcatcacacgcctctccatgggtcatggctgttgccgtaatcctatattgggtattcaacatgtatatgtcagaccgtgtgttgcgggcagcgatggacgccaagccttgtcatcatccgcatgtacaggcagcggccgatatgattttccgatcggccggcatttcccatgtccgcatatacgaaacggagagtgatgattacaacggaatggcagtaggcatgaatgtcgggaggtcaatggtcatcctgacaagcgccacactaacacttccacagcgtgtcatcgaaggcattctggcccatgaggcaattcatatcaaaaaacgtgacgttctgtcatcacagcttttgcgttttctatatcttggagctgtcgttgggattttcctcttgtttgagcagcatatcacccatcccgaggcccacaaaattgcgctttgggctttcattatggcaatcattatcctattccagctctatcaatccttttgttcacaatggatggaggtgcgtgctgacaaccttggcgcatccttgctggagggcggttacaaacaaatggctgaagccttgaaaatcttggcggttcagcaggatgaggacatacagaaacaaagtgcctacagctctgaagccggtgaagacgagcttcaaattgactctctcacccgtgataaaagctggtttttcagattgattgattttcagttcgctcctcatccccctatgtattggcgtgtcggcactttattgtcaaacaaaggacatggggtgctaaagcgctggctcagagaccgcctgaaagaatcgatcactttgaaatgaaaccggtcagcgtttcatccgtataacagatatggtgaaaaaagggagtgaccagaagtgatagtgatcttattgataatagctattattgtttttctttcagtcattcagccgcagccatcggataataaaatccgccagcaggcggacagcgggtatttcggttattcagatcatagctcgcaccatgatggattcggcagtgacggaggtttcagcgattccggctgtggcggcggagggggcggcgattaaacgccgcctttttttatttcattgattcgatgtacgcaccaaaagccgagcccgacatgcctggggacacgcgcacacgatggagggcatacattccctggtctctcgaagccgcgcccggttctgtcgtcacgcccatttgatagcctgttttttcagcggccttcagcgtctcctcattgtagcgccctaccggatagctgatgatggtggtttgctgatgaaacatgtggtcaaacagctttttcgaatccgccatctcactttgctgctgttgaggcgttaatccgttcagctcaaggtggtcaatcgtatggctttcaatcgatatgccgtgctgtgccatttccttcatttgttcctctgtcagatgatgcttatgtccgatcgatttgccgatcataaaaatcgttgccttcatcccgtactttttcagcaccggatacgcatcttgataattgtcggtgtacccgtcatcaaatgtgatcagcacgcacttctcactcggttttttatcctgcgtcagcatgagatatgcctctttcggcgttaatgtctgatagccgttatcatgaagccacttcatatgcgcctcgaattctttctttggcacacggaggctgtttcctgaagaaatgctgtggtacatcaaaatcggcagctttgccggtttctctgttttgatccatgcggatgtatcgtcttcttttttctgaacttgtactgcctttttttccggtttcttttgttccgcttttggcatcggctgctctgcattcgcctcttgatcagcgcaagccgcaagagccaaacagctgcccaaaagaaagatgcttaaaaacaatcgtttcatcgttctcctgctttctgtctatttcttcctcctttttcatcggtttgattctgagattttcaatagcaaaaaaccggacatgtctccatgtccggtttttttgatcctattgaattctcacttctgtctcactgtcaaagaaatggcctttattcatatcaaatgcaaccgtcagctcatcgcccgattgaatatcgaggcgggcgtcgatccgcgcaataaagtcttggttgtctatctgcgaataaatcataatttcagaaccgagcagctctgcaacattgattttcgccttaatcgaagagttcttatatgattccacgacaatcaattcatcatgtatatcctcaggacggatgccgaagatgacctctttgccgatgtagcctttttcacgcagcactttcatttttccttccgggacggttaatgccgcagaaccgattttgattaagccatccgtgagctttcctttgaaaaaattcatcgccggtgatccgataaacccgccgacaaagacgttttcagggaattcatatacatccttcggcgtcccgatctgctgaattttcccatctttcatgactacaatccgtgtcgccattgtcagcgcttctgtctggtcatgcgtcacataaatcgttgtagtctgcaatctctggtggagcttaatgatttccgcccgcatttgcaccctcagcttcgcgtccaggtttgacaaaggctcatccatcaggaacacctttgcatcccgcacgattgcccggcccagcgcaacccgctgtctctgtccgcctgacagcgctttcggtttacggtgcaaatattcctccagcccgagaattttagcagcttcctctactctttttttgatttcaggcttcggcattttccgaagcttgagcccgaacgcgatattatcgtagaccgtcatatgcggatagagcgcgtagttctgaaataccatcgcgatatccctgtcctttggcgctacatcattgacccgttttccttcaatataaaaatcgcctttcgaaatttcttcaagtcctgcgaccattcgcagcgtcgttgatttcccgcagccggacgggccgacgaatacgataaattccttatcggcaatatgaaggttaaagtcatcaaccgccggttccttctgatcataaaatttataaatgtgctccatccgcaattcagccatctaacatccccctttgttattgtaaacgctttcttatattgagtgtaacagcaattccctctcgctaaaatgggcagcgttcataaaatcatccagccatttttcgtgcatatttccaatttattctgaactttcattttgcaggcagataaaataggcaagaagcgcgcctttgtacgatttgatatctatccctgaccgctcaataaatttatcaatccgatattgcaggctgttgcgatgcagatgcagctttttcgctgttaatgtgacgtttgagttgttttcaataaacagcttaatggtcttccttagctcagcttcacttccaaataaaagctcagcttcttcagagagcagcgtttccagtttttctttttctgtttctaataatagaaaaggaaagatcatctcaaaggtcacactctgcacctgaggcagccgtttttcagcaaacaggaaatacgcctgttcacgagtgtaatgttttcgcagacactcatccggctcgtaaaatcttccggcgtaaaaacggacactgaagtagaaatcactttcaagaacttttgcgagcgattccagttcgcccttcttcgccgccgcttcactttcctgctcgacaatcacgcctctgtcctcatgaatccacacaatcacaaaagacaccggccaaaaatggcgaaccgcttctgtaaaggacgtcctttctattttgccgaataaatgaaagtgaacaaatctcgtccgtttctttatgtacgccggcaattcccctctggaaaaaaggaacgaaaaccacttgttttcctcaggtgatttcatagacagttgattgccctcatccgcaggcgtcaaaaatgattgcagcaccaatacttctttttcactgatctctgttttcggaatggagatatacctctgattgctctcatcaaaaaaacatagacagccttcccttatgcaaagctcctcagacacaatcgaaccgggataaatagccagcagcgatttcatagagtctcctctcttatgtaaggatctgtatattcagtataaggcgaaacacacatgttctccactaaaaaagagtatatccggtatagatagacgagaaactgaaagggaaacctcattcgtttacatattggcttcagcggaaatagaagaggatatgcaggaccaaaggagggccatcttatgagtttcgaaacgttaaacaaaagttttatcaatggaaaatggactgagggagaaagcggacgtacggaggacattttgaatccgtatgaccagtctgtgatcacaacagcatctttggcaacgggcaaacagctggaggatgcgtttggcattgcacagaaagcccaaaaagagtgggccaagagcacgacggaagaccgaaaagccgtcctgcaaaaagcgcgcggctatttacaggaaaaccgtgaagacatcattatgatgatcgcccgcgaaactggcggaacgatcattaaatcaacaatcgagctggaacaaacgattgcgattttagatgaagccatgacgtatactggtgaattaggcggcgtcaaagaggtgccatccgacattgaagggaaaaccaataagatttaccgccttccgctaggtgtcatttcatcgatttctccatttaatttcccaatgaatctatccatgagatccattgcgcccgcaattgcgctgggtaacagtgttgttcacaagcctgatatccaaactgctatttccggcgggaccatcattgcgaaagcgtttgaacacgccggtcttcctgccggtgtccttaacgtcatgctgacggatgtaagggaaatcggggacggcatgctcaccaatccaatcccgagattaatcagctttacagggtcaacagcagtcgggcgccacatcggtgaaatcgccgggcgtgccttcaaacgaatggcacttgagctcggcggcaacaatccatttgccgttctttcagatgcggatgtcgatcgtgctgtggatgccgcgattttcggaaaatttattcaccagggacaaatctgtatgattatcaacaggatcatcgttcatcaagatgtatacgatgagtttgtagaaaaattcaccgcccgtgtcaaacagcttccgtacggcgatcaaaccgatccgaaaaccgttgtcggcccgctgattaacgagcgccaaatcgagaaagcgctggagatcattgagcaggcaaagacagacggcattgagcttgcggttgaaggaaaacgcgtcggaaacgtgctgacgccgtacgtctttgtcggtgcggacaacaacagcaaaattgcccaaacggagctgtttgccccaatcgcaaccattattaaagctggcagcgaccaggaagcgattgacatggcaaatgatactgaatacggcctcagctctgcggttttcacttctgatttagaaaaaggcgaaaagttcgccctgcaaattgacagcggcatgacccatgtcaacgaccagtccgtcaatgattcgccgaatattgcctttggcggaaacaaagcaagcggtgtcggccgtttcggcaatccgtgggtcgtcgaggaatttaccgtgacgaaatggatttcgatacagaagcaataccgcaaatatccgttctaaatgaaaaaatccctctgtttcaagtacagagggatttttctttatttagatatatccacaaacccttcgccaaacacatcgcgtacgtcatgaacgatcacaaacgcttttttgtcgcagcttctaatgatttttttcagcatagacagctcctgtttgttaatgacgatatacaaaatctcttttgattggcccgtataatttcccttccctgataaaatcgtcacgccccgatccatcaaggtattcacctgctctgcaatctcactcttattttctgaaatgaccgtaatggcttttttcgtattcaaaccttcaataatgaagtccatcactttggtaccgatatacagcatcacgatcgtaaacatcattttttctgcaccaataataaaataagagctaaatactacgattaaatcaaaaaacaagagtgcatagctgatattccagtctaaatatttattagcaattctggccagaatcgcggaaccagccgtcgtcccgccgacccggataatcatgccgatcccgactccggcaaatacacctgcgaaaatcgtattaatgatcaattcatcagacggaatgctccacccatgtgtcagatgaagaaaaagcgaatttgccgcaaccgcaatgatcgtataaaccgttgtttttccatccagaaacttgtagccgattaaaagcaaaaacgcatttaagataaagttcgtgacaccaggagaccattgaaacagataatacaatatcagcgtaatcccagtgactccgccttccccaagatcattgggaatcgcaaataaattaaccgcaagcgcgaagaaaaaagcgccaatcacaagcataagtacatccagcattctctttttcatcacgaaaacactccttctcattgttctgttctactagcaaataaaaaaacccaggagaacgctctcgaaaaagagcagaaactcctgggcttttatcccaccgtgtcataacagccaatctgctatgtgttttctctcggtcacagtccaatttgcattgcggaaccctagaaaaccactgtttttatcatatccttttcactttccaatattagcattataagggacggttcgaattggttcaaggggtatttgcggagttttcatcagataagctggaagaaaaaacgatttatctattaaaaaagaacagatataaccgataagaaaaaaagcatatattttacaagtaaatgtaactataaatgataataattatgagaaattcataattttatattgactaagtgaaataatataggcattatagtacatatgtttcgtacattttattacataggaggaaatataatggcaggaaaactagtaccctgtaaagcttgcggtcaagaaattgcaaagggtgtaaaaaaatgtcctaactgcggtaaggatcaacgtaacttttttatgcgacataaaatcattacgtttattctcgcagttgttgtcatcattattatcggtaatatgattggcggcggaggcggttcagaagccacttccaaaacatcaagcggaagcaaagcagaaactgaaaaaacatacaatatcggtgatactgtaaaaactgaaaaaactgaagtgacagttacgaaggtagaggacagagatactgtcggtactcaatatgttgaaaagaaagcatctgatggtggtacaattgtagctgttcaatatacaattaaaaacgtatctaaaaagccaataagttctttttcaattccaactgttaaattagttgatgctgatggtacttcttatgattctgatattgatgcttctgtaaactatgcaactgagacaaaagttgataactctaaaattttgagtgatctaaatcctaatattaaagtaacaggtgtaaaagcatttgaagttgacaaggaagcttatgcaaaaggcacttggaaactaaaattcagtaatgatgttattgtgaaaatcaaataacagctaacaagggtgcctgttcaggcacccttgttctttaaaggccttctctattgagaaggcctccattcttattccgcactcttatacccattcacattagaagactgccatctccaggaatcagcacacatttcctcaaggccgcgtttcgcttcccagcccagttcccgcttggctttcgcaggatctgcaaagcatgtggcgatgtctcccgggcgacggtccgcaaaacggtacggaacctctttccctgacactttttcaaaggctttgaccatttcaagcacgctgtagcctgtgcctgttccaaggttgtatgcatcggctcctgtagagttcaatactttttccagcgccttgacgtggccttctgcgagatcaacgacgtgaatataatcgcgtacgcctgtcccgtcttttgtcggatagtcatttccgaatacgcttaattgctcaagcttcccgactgctacctgtgccacatacggcataaggttattagggattccgttcgggtcttcaccgatccgtccgcttggatgcgcgccgaacgggttaaagtaacgaagcagcgcaacgctccactcattgtcggctgtatgcaaatcacgcaatatttgttcaagcatgagcttcgtctgcccataagggtttgtcgcacctaatggaaagtcttccgtaatcggcgatgtttccggaacgccgtacactgtcgcagatgaactgaatacgattttcttgacgccgaatttctccatggcctcgcataaaataaacgttcctgtcagattgttatgataatatttgagcggaatcgccacagattcaccaactgcttttaacccagcaaaatgaatcacagcttcgatttcattttcagcaaaaaccgcatctaccgcttcccggtccaataagtccgcttcgtagaacgttaaatcttttcccgtaatccccttgacacggttcagcgcctcagccgaactgttggacagattatcaagaacaacaatctcgtagccgctgttcaataattcaacacatgtgtggctgccaatgtacccggcaccgccagtaacaagtattgccatgatgtaaccctcctaaaaaatgacctgttttcattatatagtgtttaaaaccggtccacatccatttttaagaagtttaatcgtttattaatagttttttcatatattatcagcattttcatacctttatgcagcgtgaacaagtatagcagctgaaaaatcaatctgccggttgacgtttttctttccctttttcgctatgcttaatgtagaaaggatttgatgacatggcgatgagcccatatatttttattgtattgattcttattattttatcgatgtaccgagagagagctgtcagacccgggaagttgctgatcattccgctgctgctcttatggggcgtatcagcatcgtttcagccggcgtattttcattccgtattacatgtggcgatcagcggcattttattattaatcgggctggcctgcgggtttggcattggaaagatggtaaacgtgcggattcacccggaaaccggaaaggtcacttcacgcggctcacttgggagtgttatcctcattctagtgatactttctttgcgcatggccgcgagaacatggctgcctgagagcaacgagatgtttattgccattattcattctatgttcttcattcccctcggcaccattacagcccgtaacattatgctttataaagcatacagacggctgaccgctggcaaggtatccattcaataactgaaagaaggaccagcatgaacagacaaactccggctcggcactactacaagaagcttgtgccgagccttattctcattttgaattgcatacaatttttatctcacccagccaaagctgatcccattttgttggcatttgtatttgcggtgtacttagcattcatttgggtcattccctatgtggcatccactgctgttagtttgtgcatattcatcggactctggctcctgaccgatttcttttgggctgtttccggccaagagcagggtgccgcctattttttgattgtatttttaatgatatatgccgcctttagactcccttcacggctatccttgatcttcacagcatgtttaattggaggcaacatattactcctatcctcacaagggggaagcttgaataccatcatcagcaacatctcgatcatgctcgggctgtacgtcctcttctcctccatgcgtttcagacgagaagcgagaagggaggctgaacggaatcatgctgaattggcaaaaatgcatgtgcagctggagcatgctcataaagaactccagaaagcgcatgcagagctgcaggaggcttctgttctttcattaaggtacgcggtccttgaggaacgtacaagaattgcccgcgacattcatgacagcatcggtcacgagctgacttctgttattgttcagcttcaatcccttccctatatccttaaaagcagcaaggaggattcagaaaaagtcattcaaaatgtactgagtgtcgccagggaatgtcttcaagaagtacggtctgtcgttcaccaaatgggccgtagtgaatcgatggtggggcttaccgctttgcgggggctcattcatcaagtggaggaacggagcggcttgcacgtttctttagatactgccggactatcagaagagtcttggcctccaaacgtgagcgaaacgatctaccgcatcttgcaggaagcgctgaccaatatcattcgtcacgctgacgcttctcatgcggcggccgtcatttctaacgacaagtcccatctctatatcacaatcaccgacgacggacaattcaccggcagccttacttatggatttggcctgacaggaatgaaagagcgcgcagaaaaagcaggcggttcccttactttcagtgccgtacagccgagcggcctgaaaattgagctgtcattgccgctcatgacaacgaataaggagcaaaaagatgaacaaagataacatacgcgtcgcgcttgccgatgatcagccgcttgtgcgtgaaggcttccgctacgtcatcaacgcacagacggatatgacggtttctggcgaggccggcgacggtcacgatattatagcactcgcaaaacaaacaaaacccgatgtcatcctcatggatgtccagatgccgcgttgctcaggcatcgaagcagcgaaagacattatgtccgcacttccagatacaaagatagtcattttaaccacctttgacacggaagaatacgtatttgaaggcatccgtgcgggagcagtaggctatctgctgaaggatacacttcctgaagagttgatagatgcgattcgcgctgcggccagaggcgaggcgattttccgtacagtcacagctgctaaaattatcagtgagacatttcaggcgaagcaacagccccatccagaagaactggcagagccgttcaccaaaagagagcttgaggttcttcagcaaatggcctacggactgagaaatgaggatattgctgaaaagcttttcgtcagtgaaagcactgtgaaaacccacgtgcaccgcatcctgcaaaaatgcaatgcccaagaccggacacaggcagtcgtttttgccattcgaaacggtattgtgcaatagaaatctctcatcccgccatgctaaaataagacaaaggagatgattggaaatgaaagaagaaatcattgaacggtttactacatatgtaaaagtcgacacacagtccgatgaatccgttgacacttgtccttccacacccggccaattgacattaggaaacatgctcgttgatgaattgaagtccatcggcatgcaggatgcagccattgatgaaaacggctatgtcatggcaactcttccctccaatactgaaaaagacgtgccgacaatcggctttctcgctcacgtcgacaccgctacagactttaccggcaaaaacgtgaatccgcaaatcatcgaaagctatgatggaaaagacatcgttctcaacaaacagctgcaggtcaccctgtcacctgatcaattccctgagctgtctggctataagggccatacactcatcaccacagacggcactacccttctcggcgcagacaataaggccggtatcgctgaaatcatgacagccatggattacctcatcaaacaccctgaaatcaagcacggcccgatcagagtcgcctttacgcctgatgaagaaatcggaagagggccgcacaaatttgatgtgaaacggttcaatgcttcctttgcctacacggttgacggcgggccgctcggcgagcttgaatacgaaagcttcaatgccgctgccgcaaaaattacgattaaaggcaacaacgtacatcccggcacggcaaaagggaaaatgatcaactctgcgaaaatcgcgatgaagctgaacagcctgctgccggcagacgaagcgcctgaatatacggaaggctatgaaggcttctaccacctgctgtcgattcaaggagacgtagaggaaacaaagctccactacattattagagactttgacaaagagaatttccaaaacagaaaagaaacaatgaagcgtgtcgttgaagtacttcaaaacgaatacggacaagacaggattctgctggatatgaacgaccaatactacaacatgagagagaaaattgaacctgtcatcgaaatcgtcaacattgccaagcaagcgatggaaaacctcggcatcgaaccgaagatttctcccatccgcggcggcaccgacggatcgcagctgtcctatatggggcttccgacgccaaacatctttacaggcggggaaaatttccacggcaaatttgaatacatctcagttgacaacatggtcaaagccgtaaatgttatcgttgagattgcaaagcagtttgaagcgcaagcctaatgccaaaaaaccagtccaaaaaaggactggcttttttgtgtgaaagtgaaacattttaaacgcgtcctccgtaaaacaagtattaacaaatgaggaggaaaaacaatgacaaaacatgcaatcgctgcaaagagtctcttgaaaaaatggatcatttccaggccgcttaacatgcaaaagaaatccagcccatttcaaaaaatcagaaaaatgttcaaacgcttcttcaaataaaacattcaaatcccctaaatacaatccgtattcacccgtaccgcccaaatgctccgtaatttgggttttttgtgttcaattccgcaaaatagggtataaaccaaacaagcaagaaaacagcacccaaaaacaggtaattcgaattacgtaaacttaggttaaaagttatataaaggaatttattttatcgtcgatagtaactatagaaccaatcatcaacgagagcaaacagcgtaattcaagactattttcaggtcatcaggtaatactgttttagagggacagtttcttgttatttattgatttagaattttttgaatactttttggcattttatccgtacaatagagagtaccaaaactttttttgggaggtatgtaatatgatcctatttattatcatcgcattatgcggctatcttcttttttctttcagcaaggacaatcgccgcaaaccgcaaaagacaagccctctgccagcagccgcacctcatcacaacaacctaatcgaccttgacgccatccgccaaaaacgccggatgcatctttcctaattctatatttcaaacgaaaaggctgctgaatcacgcagccttttaaaattgttttgatttagagcctgaaaccttttcgccacatatccgtaatttcatacaaggcaaacccaaaggagacttcagcaatgatcgagttatttatgaaacaaaaaatgttctcatttaaagatgcatttcacatttatgaccgggatgaacaagaaacattcaaggtggaggggcgttttttctcgttaggagactcattacaaatgacagactcatctgggaaaacgctcgtttccatagaacaaaaactaatgtctttattgccgcgctatgagatttcaattggcgggaaaacagtttgtgaggtaacgaagaaatgtaacgtttttcaaaccgaaatttgtgatttccgggcttaactgggaaatcgatggtgatttatggagggatgaattccagctgacggacggggaaaatgtccggatgtcagtgagcaaaaagtggctcagttggggtgattcctatcacttgcagattgcaaacgaggaagatgttctgatttgcactgccatcgctatcgtgcttgatatggttttatataacgatgaagatgaaggtattttctaaaaagcattgacaattgatccaaaagtaataatattaagataattgaaatctgaatatgaagttataccttatcaagagaggtggagggactggccctatgatacccggcaaccgctgtttcaaacagaatggtgctaaatccttaagaacattgtgttcttgcagatgaggcggagatttgatcgttcaagctcttccttacacaaaggaagagctttttacatgctcaatatttcagaaaagaggcgaataacatggctcaacaaacgaatgttgcaggacaaaaaacagaaaaacaacgcaaagcacctttccgcgccgatcatgtcggcagcttgcttcgttccgttccggtaaaggaatcccggcaaaaaaaagcggcaggtgagatgacagcggaacagcttcgtgatatcgaaaatcaagagatcacccgcatcgtggaaaaacaaaaagaaatcggtctcgatgtggtaacagacggggaattccggcgttcctggtggcattatgacttcctggaagggcttgacggtgtggaaccgttcattccggctgaggggattcagttccataacacaaaaacgaaagcgcgcagcatcaaagtgacgggaaaactcgattttacgagccacccagcgcttgctgattatcaatttttacatgagattgccggtaacgcgacgccaaaattgaccattcccagcccaaatatgctgttttttggcgaaaaggcggataaagggatttatgacgatcaagaggaatactttcatgatctggcccaagcgtacaaaaaagcaatcaaagccttctatgatgctggctgccgttatctccagctcgatgatacgtcatggtctctcttctttgaggaaaaaggcagagaggttgtccgggcgctcggcggcgatccagaaacattgccagccatatttgccaaaacaattaacgatgccgtcgcagaccggcctgacgatttaacgatcacaatgcacatttgccgcggcaacttccgctcaacctgggcggcatcaggagggtacgacgctgtagcggaaacgattttggacggcttaaaccttgacggccttttcttggaatacgatgatgaccgctccggaaactttgatccgctccgttttgtgaagcgcaaggatctgcaaattgtgctcggcttgatcacatcgaaatacggcgagcttgaaaatcctgaggatgtgaaacgccgtatcaatgaagccgcgcgttttgtcagcttggaccagctatgcctgagcccgcagtgcggtttcgcctctacagaagaaggcaaccttctgacagaggagcagcaatgggcaaagcttcgccatgtcatcgacattgccaacgatgtgtggagataatctatcattgacagaaatagaaaatgtgtgaataatagatactatcagaaaatttcataaaaaggttttccttatcaagagaggtggagggactggccctgcgatacccggcaaccgctgtttaacagaatggtgctaaatcctttagagcaatgattgctcttgaagataaggttgagattgtcacgcaagctcttccttatccaaaggaagagcttttttacatttgaatggaaagaaggaatggacaacatgtcacaacaaacaacacccgcagaacaaaaatcacttcaaagaaaaaaaccgccgtttcgcgcggatcaagtcggaagcctgttgagatctgagcccgttaaaaaagcgcggctgcaaaaagcggccggcgatattacggctgagcagcttcgccagatcgaaaacgatgaaattatccgcattgtggaaaaacagaaggaaaccggcctgaacgtcgtgacagacggtgaattccgcagagcatggtggcactttgatttcctggaaaacttagatggcgttgagccgtttactcctgagcaaggcattcaattccataacgtacagacaaaagcacgcggcattaaagtcacaggtgatatcgacttttcaactcacccaatgcttgaagattactcatttctccatagcattgccggtgacgcgacgccaaagatgacgattccaagcccgaatatgctgtttttccgcggaaaattggaaaaaggtgcatacaaaaacgactatcaccttttccagcatgatgtatccaaagcatataaaaaagcgattcaagcgttttatgacagaggctgccgctacctccagcttgatgatacagcgtgggccgttttcttatctgaaaaaggcttaaaacaaatcgaagcgttcggaacaacgcctgacgagcttcgccagctgtttgcgaaatcgattaacgacgcgattgcagaccgcccggatgacttgacggtaaccatgcatatttgccgcggcaacttccagtccacttggacagcggaaggcggctatgacgcagcagccgaaaccatttttgacggcttgaatcttgacggacttttcttagagtatgatgattcacgctcaggcggatttgagccgctccgttacgtaaaacggtctgatcttcagcttgttcttggcttagtgacatctaaattcggtgagcttgaaaatccggatgacgtgaaacgccgtatcgaagaagcgtcccgttatgtaagcttagaccagctttgcctcagccctcaatgcggatttgcttcaactgaggaaggcaacaagctgactgaagaacagcaatgggcgaagctccgccatgtggttgagatcgctaatgatgtttggaaataagaaaagaaaaaacacacttgattccctagcggagcaagtgtgttttttatgtcattgtgcggtgtagcccccatcaaggacgacagcctgcccagtgacgcccttcgccttctcgcttgccaaaaacacggcataatccgcaatttccttgacggaaagcagtcgcttttgcggcacaagcggaaaaatgacttgttcaagtacagagtcgtaagggacatttctagttttcgatagatcgctaagctgattgcgtacaagctgggtatcgacataacccggacagagcgcattgactgttatgccgtggggcgcgccttccagcgcccctacttttgtgagtccaatgacgccgtgcttggcgctattataagcggatttccctgcaaagccgactaatccattaacagacgcgatattaatgattctgccaaactgctgttttttcatgatcggaaaaacatgcttcattgcaataaagggggccgtcagcatgaccttgatcagctgttcaaaggtgtctgtcggaaactcttcaatcggagcgacgtgctgaataccggcattgttcaccagaatatccaagcggccgtattgtttttggatgacgttcaccgtatcagcaacttgcgcttcctttgtcacatcatacggaatggccgccgcgtcaaagccttcttctgcaagcttggaggctgctttttcacatgcttccggacggaggtctgaaacgatgacgctggcaccttcccgggcgaattctcttgcgatttcgaatccgattccgccggcagcccctgtcaccaaagcgacttgttttctcatgtcaaacaccttcccattaagaattgagtacagactggcttacagcgaaatcagcttctgttttttcataaacctcttcaattgtgacaccatcctgaagctccgtcagtgtcatgcggccgttcacaaaatcaaatacagccaaatccgtaatcagcctgtgtacgactttctggcctgtcagcggatgagagcatgtttttttcacctttgattcaccatgcttattgacgtgctccatgatgacaacgattcgtttcgccccgttgacgagatccatggcgccgcccatcccttttaccattttgccggggatcatccaattggccaaatcaccctgctccgaaacctccattccgccaagaatagccaaatcgatatgcccgcctcttatcatcgcgaatgactcagcgctgtcaaaataagaggcgcccgtcacttcagtgatcgtttcctttcccgcattgatcaaatccgcgtcttccgttccttccagaggataggggccaattccgagcaagccgttttccgactgaagcatgacgtgaacgccatcgggtatctcatttgcgacaagcgtcggcattccaatcccgagattcacattcatgccgtccttgatttcttgtacagcccgtttgaccattcgttttctcgcttccttcacttggcctcaccctttcccgatgcttgctgaactgttcgtttttcaatccgtttttcttggctcgcgccaagcacgacatgctgtacgtaaattcccggcgtatggatatgatctggatcgagctctcctgcttccacgatttcttccgcctcggcaatcgtgatcttgcctgccatggcggcaatgggattgaaatttctcgccgttttcctaaaaaccaaattgcccatggtgtccgctttccacgctttgacgatcgccacatcgccggtaatgcctcgctccagcacataagtccggccgccgaatgttttatgttcttttccctcggctatggaggtgccgacgcctgtcgccgtataaaatcccggtatgcctgcaccgcctgcacgaattctctcagcgagcgttccttggggaacaagctcgacctcaagctctccgcttaaaaactgccgctcaaaaattttattttcaccgacataggaagcgatcattttcttgatttgcttgttagccagaagcaaaccaagcccccagtcatcgactccgcagttattgctgacaacggttaaatcctttactccctgatctcttatagacaaaatgagctgttcagggatgccgcacagcccaaaccctcccgcgatcagcgtatccccatcatgaatcagtttcgcagcttccttgcttgatgacagcactttttccatattgatgcccctttcgttttcttctacactagaccagtcaggctgtaaatcgcgatcacagcaaatacggcagccgttttaatgagcgtgatcgcaaaaatatcgcgataggattgccggtgggtcaaacccgtcacggccagaagcgtaataacggcgccattatgcggcagtgtatccatcccgcctgatgccattgaaatgacccgatgcatcacctctggcggaatattgtaagcctgaatcgcctgtaagtattgttctgacatcgcgcttaacgcaatgcccattcctcctgaagccgagccggtgattcccgccagcgcagttgtcgtaacggcgccatttacaagcggatcggtaaaagtatgtgaaattccgctgctcagcttatgaaaccccggcagtgcggcgataatgccgccgaacccgtactcggcacccgtattcatagatgccagcaaggcgccgccaattccttcattcagcccttccttcaattgggcaaacacacttctccaatcaaataaaatcgttgtgatgatgccaatcactaaagcaatctccaccgaccaaatagcagctgctgaagaaatatcaagcctgccgaactcctttaatcctatggaagaaaaatcaaatccattcggataccactttggcaggtaaatggtaaaatatttattcactgcaccgacgagaataagcgggacaaaggcaagcgcgtgccgaatcgggcttttgtccggttcagccgcggactcaatcgattcaggagcaggagcattctgcgaatcaaaaccgccatagccttcgccagatgcctgcgcttttttccgccttgattccaaatagagcatcccagctgccagcacaatcactgcgcccatcaagcccagccaaggggcggcataaatgtctgttttgaaaaacgacgtcggaatgacattttggatttgcggcgttcccggaagtgcgtccatcgtaaacgtaaaagcccctaaagcaatcgttcccgggatgaggcgttttggtatgtttgcttcttggaacatgtttttcgcaaaaggatatacggcaaatacgacaacaaacaggctgacaccgctgtacgtcaagacagcacccatcagcacaatggcaagtatcgctctttttgccccgacaagccggacaattgttttcgcgattgatgccgcaagcccggccatttcaacgacctttccaaaaatggcaccgagcaaaaacactgggaaatacagcttaataaaacccgccatcttctccataaaaattgatgaaaaaaaaggaagcacatggcttggatctgtcaggagcaccgcgaataacgcgcaaatcggcgcaaacaatatgacagaaaatccccgatacgccgtaaacatcagcaaacctaacgccaatagaatgatgatcagttccacacacacatcccccgtttccgcgaactagaaagcgtttacaaaaacctgtccgcatcggctgtttccgtcccctttccatatgtacgagaagcgtgggccaactattccgattaaaaaaggaaagctccttttttcggagctttcctctgccattcatttcattcctattaggatatcaacatcaaccgtaatatcggctgttttcatctctttcaggaggctgactcgatctttcggcgccgaccaggcaagcggcgtcatcttgagaagccagtggatcgcctgctggtcaagcgttttaacatagcgcagcctgacaggacggctgtgtgcagcatttgctgcaaaacgctcaacagctgccgcattggaatacgtgcgccttggtgaatcagtatataaaaattgccttaattctattaaatagtcgcttcgcggcactacttttacgagcatgccatcattcttcagcagtctatgaaactctgcataattggacggcgaaaaaatagacagaacaacatcaaattggcgatcatgaaaaggagcacgcgccacatcggcaaccgcccacatctgatctttgaatgccttagaagcttttaagatcccatccttcgaaagatctatgccggttcctatcgctgctttccctgcataatcaaacccgcaaagcgcattcaaatgagaaccctcaccgcaaccgctgtccaggatggtgaatgcctcatgaccagatgtgggatgactgatgagttctgcaatcgcatcatggagcgggtcaaaaaaaccacattctccaatcagcctgctcctcgcttcaaaaagctcggcaccgtaactggttttgaccggcttcgtcagaaagttcacgtagccgtgccgagatagatcaaatgtatgtcctcgttctgtacaaatcaagcttttccctgatgccgcatccatagaagaatcgcagagcgggcatcgaaacatgctgaaatcaactgttcgcttcatgataaaaaacaccccattcattcatttttagataaatgaaaaaggcatagacaaataaacctaggcctatctcaaaaattggccaggtctggcagtttgtctacacctgtcattatctataacgaatgaattggataatcatgaaaaaactccctttctgctgtatgggtttccccatttccattatacaacaaatctccaggatctggaaccttatagtgaagaaaaatcagtactgacatgctggtatcccgccaacatcatatcagcatagcaatccagcatgtttttcctttattttctcattttagaatataaattttattattgtgaaaatagttaaaaaggttgattttcaaaaagtgaaaggataaaatactgctatcatcttagaaaaagacattcttgtatatgatcagtaatatggtctgattgtttctacctagtaaccgtaaaaaactagactacaagaaagtttgaataaatttgaacgagttgaaaaggacaagttcttttctgtttgctcttatttttcacactttctgcacttccagaatttgtgaagaataagagctttttttgtttccataataaccctcataggagttgctatcatgtactttttactaaaccttgtcggtctcattgtgattatggcagttgtattcctatgttctccgcagaaaaagaaaatcaagtggcgcccgatcatgacgttaattgttctggaattgctgattacttggtttatgctgggaacaaaagtcggaagctgggccatcggtaaaatcggtgatttcttcacttggctgattgcttgcgctagtgacggtatcgcgtttgcctttccgtcagtaatggcgaatgaaacagtagactttttctttagtgcgcttcttccaattatctttatcgtcacattctttgatattttaacgtatttcggcattttgccttggctgattgataaaatcggatgggtgatttcaaaggcttcccgcttgccgaaattagaaagctttttctctattcaaatgatgttcctgggaaataccgaagcacttgcggttatccgccagcagctaacggttttaagcaacaaccgcctgctcacattcggcttaatgagcatgagcagcatcagcggctccattatcggatcttatctttcaatggtgcctgcgacatacgtgtttacagccattcctttgaactgcttaaacgcgctgattatcgcaaacctgctgaatcctgttcacgtgccggaggatgaagatatcatctatacaccgcctaaagaagagaagaaagactttttctctacgatttctaacagtatgcttgtcggcatgaacatggttatcgttattttggcaatggtgatcggatatgtcgcattaacgtcagcagttaatggcattcttggcgttttcgtacatggcctgaccatccagacaatttttgcttatctgttcagtccgttcgcattcctgcttggactgccagtgcacgatgcgatgtatgttgctcagctgatgggcatgaaattagcaacgaacgagtttgttgcgatgcttgacttgaaaaacaatctcaaatcccttccgcctcacaccgttgcggtggcgacgacattcctgacgtcctttgcaaacttcagtactgtcggcatgatttacggcacgtacaattcgatccttgacggagaaaagtcaacggtcatcgggagaaacgtgtggaaactgctcgtcagcggaattgcggtatctttattaagtgctgcgattgtcggcctgtttgtgtggtagaaacattgagccatatcccttttcggatatggctcttttcattattgataaatagaggctggcacctgcacatcccggattcccgctgcataaggccccaagtcatactggccgaagacgatggcgatcccgtttgccgtaaagtaaaacattgtgtctctgtttagggttatatcctctttctttacatcagggaaaaacagctcatcgtgttttttgatatagctatataggtaatctctcgttttgctgacttttgttttggtgttcagaatctgatccagcgtcacccgcttttgtgctttcaagtcatagttgaaggactggacagacgttaaaccgtgggcgccccctgaatagatataattgagtgtttgaatgctgagcttgcctgccgcattgtatttgacgctaaaggatgtttgatattccgttttaaagccctgctgttcgcctgcttttttgtttttcaggtattcctgatacgattgttcaatgtaggctttcagctcttgattgattttcttttcaaacgcggcattcccgatgtgatgcacttgtggatacgttaactccttgatctttttgtacgtatgagtgctgacagtcggtgttttcgtttgaactgcgtttagagatggggccgcatatgcaactacggaaaaaagcaagactgcaatccccgcggctttcatcattttattccatttcatacaatctcctcctttgatgtcgttgtttatcattcccttatttaagcaatacacacttttatagactgattaaatcgaaagaagtttctaggtctaacagcatgatttttccaataaaaaaagagacacaggatgtctctttttttactgtttgcgcccaaaaatcgcttcatgaacggcctgtgccaaatctgtatttccgaacatctctaataccgcaatgacagtctggtccggaatgtgctctgcttcgtgttttggcacgaccagatcgtccatggtttttttcaagctttcattcagcttttgctgcggatacgctttggtgtacatctccaccggatcaagatcatggttcacgcaccattgggcaaacaccaaaatcatcatattttcatcgcgttcgtaagcttcagcgagctgtttttcgttcatttgtcatgctccttatgaaaagtatcttccttaaagatacaggagccgatcaaattcgtctatcccaatggcgatgagcagaaaccgcatcgataaatgccttgctgaaagcggtgtagtcaggttcatctttagccgttacgatgcctggcccctctgttgtcccgacagaggattgaagaaggtcaattccttcatttgccgcaccgatcgccttgtagtgattgtaagcttctctgataaactccatcgcttgtttgttgtcttttaactccggccctcctgcggcatagacggcatcatacagaacagaatcaaccgtcaggaacgtgccgctggcctcaagctgctgtccgctgccgcttgtcatataccccagattttgactgatgatatctactgtgattccttcttgctttaaggcttccagcactgtttgcagctctttttcatgaaatccgtttccggtgagtacagcgacttttcttgttgacgcggttttcactgtacgggcttggcttaacgcaggcgaagtaagaatttctttagatgctttacgcttcgcgggcgccgccacgcctactcctttggcgatttcttctgctaaatctgcatcgacattgctgaagacatcaacaacctgccgctgtacgtctttgcttttgaccttcccgacctcgaagcagaaagcagaaatgatgtgctgtttctccacaggagacatgctgttccagaaaagcttcgcctgtgagtaataatcgttgaagctgtcgcttcgctggcggatttttttgccctcgactttttcctgatagtggacgtagccgccttcttcagctgtcgcaggcgacggatcattgttttgcagtgagtttttatgataagcgacaggccccttattgatcgtcatccgatgataaccgtcatattgattgttatggaatggacataccggccggttaatcggaagctcatggaagttcggaccgccaagacgaatcagctgtgtatccgtataagagaaaagtcgcccctgcaatagagggtcatttgtaaaatcgatgcccggcacgacatttcccgggtggaatgcgacttgttctgtttccgcaaacacattatccgggttgcggttcagcgtcattttcccaatgatcttcaccggcacaagctcttccggccacagcttagtcggatcaagaatatcaaaatcaaacttgaattcatcttcctcatcaatcatctgcacgccgagctcgtattcaaccttgccgccgttttcaattgtttcccacaggtcacggcgatggaaatccggatctttcccggcaattttctgcgcttcatcccatacgagagaatgcacgccgagcaccggcttccagtgaaatttcacgaaacgtgcctttccttgttcattgacaaaacggaacgtgtgaacgccgaagccttccatcattctgtagctgcgcgggatgcctctgtctgacatcgtccacatcaccatgtgagccgactcagggttattggcgacaaaatcccaaaacgtatcgtgagcagtcgctgcctgaggcatttcattgtgaggttcaggcttaaacgcatgaaccaaatccggaaatttgattgcgtcttgaatgaaaaacaccggaatgttatttcccacaaggtcatagtttccttcttcagtataaaattttgtcgcaaagcctctggcatcccgcaccgtgtctgcggagcctttagaacccgcaaccgtagagaaacggacaaataccggtgtcttcaccgaagggtcctgaagaaatttggcccgtgtatattccgtcattggttcgtaaacctgaaaaaagccatgcacgccatacccgcgtgcatgcacaacgcgctccggaatcctctcatggtcaaagtgcgtcattttctcccgaaagtgaaaatcctccatcagcgtcgggccgcgaaccccggcttttaacgaatgctcatcctctgatactcgcaagccttgatttgtcgtcattttcttcccgctgttatcggtcctgtactgctcaagctgctcgtcctttgagtgttcatttacacgtttgttttggtcatcactcatgtctgctcccccttttaaaacgaaacattctacagcacatttacccgtggcgttcttcatataaactgctaatccgctcattaggatttttggtctacatataaatatgcggtcatacacatttgaaataagccttcttcacagaaagaaaggatggaagcgcttaccaaaaaagctgttgaataggggaggtcatatcatgcttgccatactcggttttgtgatgatgattgtctttatgtaccttattatgtctaaccggctttccgctcttattgctttgattgtcgttcctattgtgtttgccctgatcagcggatttggcaaagatctcggcgagatgatgattcagggcgttacagacctcgcccctaccggtatcatgctgttattcgccatcctgtatttcggcattatgattgactcaggcctgtttgatcctctcattgccaaaatcttatcgtttgtcaaaggagatccgttaaaaatcgccgtaggcacagcggttctgaccatgaccatttcgctggacggagatgggacaacaacctatatgattaccattgcagcgatgctgcctctctacaaacggctcggcatgaaccgtttggtgttagcgggaatagcgatgctcggttcgggggttatgaatattatcccgtggggcgggccgactgcgagggttttggcttccttaaaattggacacgtcagaggttttcacgccgctgattcccgctatgatcgccggcattctctgggtgatcgccgttgcttatatcctcggaaagaaagagcggaagcggctcggcgtcatttcgattgatcacgcaccgtcttccgatccggaggccgcaccgctcaagcgtcccgctcttcaatggtttaacctgctgctgactgtcgctctgatggccgcactgatcaccagcctgctgccgctccctgttctttttatgactgcgttcgccgttgccttgatggttaactatccaaatgtcaaagagcagcagaaacgaatctcggcgcatgcgggtaatgcgttaaacgttgtctcaatggtgtttgctgcgggcatattcacaggcattctctccggcacaaaaatggtcgatgccatggcgcattctctcgtttcactcatccctgatgccatgggcccgcacctgccgttgatcactgcgatcgtcagcatgcccttcacctttttcatgtcgaatgacgccttttacttcggtgtccttcccatcatcgccgaagccgcttccgcttacggaatagacgccgctgaaatcggaagggcctccttgctggggcagcctgtgcatctgctcagcccgcttgtgccttccacctatctattggtaggaatggcaggcgtcagctttggcgaccatcaaaaattcactattaaatgggccgtaggaacaacgattgtgatgacgattgccgcacttttgattgggattatttctttctaaatgtatgagcttgatcgtagcattgagtgagtacgtgatttacagaggggagaagatcaaataggatattatgagtgaatagaagattcatgccaacaacttctcattacaatcataagagcctgctatattgcagcaggctctttcacatttggcattatttttttgtatagcgcacccagtcataatgagcgtatagcggatttacaccattgtaggaaccaagccattcatcgacacccgtgccattccacaagttcatcatgatctttccaggtgttgtcggaatttggtttgttgcagtatgttttaattgcccgtcgacataccatttaatagagtttggctgccaatcgaatgcataagtatgataggcattggctgcatcaaacccgagatcaacaatcttctcatggtttcctgcaccatttgtataatagttaaattgaaccttcgttgtgtcttttcctaaaaattcgatatcaatctcatcccaaggagttccatctgttggacctgtgtaagtgaagaacgatgaaacgatccctgtgtttttagctggtttcattctgacttcataaagtccatagccatatgtttgaacagaacggttttccccgcagtcaaacttgttataagctgggcttgttagcgctaaacgcatttcacccaatgacgtcattgatacgttattagcccgccacgtgcagttgaacatatttccattcgaataaccatctgctttttgccaaaaaccggagttatagccgttaaaagggtcaaaaaacgatccacctgtttgagctgaggcagtagaagtgactgcaaacaaactcataaacaatccagtgacaagaagcagcaacactcgtttcagataaggcatattggcattcccctttcattgaaagcgttttctatgttgatcttacatgattcttttaaaagggaacatcggtcaaaataatgataatatcgaatcttactgacttgaatcctgtaactatcatcatcttccctctgaaaaaaataaaaacctaaattaccatcagcacagacagagatgatccgcactcattgtaatttaggttttgcctgctttatcagtaacaatcctaccattttcatatgtgaatgtaagaaaaaatgaatacaaggaaacaaaaatgtcagcgctctcattatgcttgtttaactaccctttctatgtgaatggttaaatacagcagctcgtcacttgtgagcttgtgctcatactcccgctcaatgtaggtttggattttcttcgtgcattcatacgcgcgatgatacttttctttcactgtatccagcaaaaaatcgtcctggctttccatgtgagtgccgttaaaaagacgctgcgcgaaaaactttaagtgggtgacgaaccgataatagtgaagcgattcttcgttgaattcaatcttaaaatggtattttacaatactcaaaatctcttgcatgacttttgtaatgttgataatattgggcatctcttcattcagctcggcatttacaatatgcagagcaataaagcccgcttcatcctctggaagagacacacctgtcttgtttttcaccatgaccaacgcttctttgccgatcgtaaattcgtctttatacagccgttttgtttcccacagcaaggcgtttttgatatcaagccctttctggttgcgctggatggcaaagttaatatggtcggtcagcgacacatagatgctgtcgttgagctttttgccgagctgtaattttgcgtagctgataatctcttcggatacttccatacactcgatcggtatatcatacaaaagggttttgaacttttctgatacatccttgttatcgagcgtgaacactttctcaatgcgggcttcatcgacatcatcgccggactttttctgaaacgcgagccccctgcccatgacgaccaattctttcccttgttcattgaccacgctgatcacattattgttgatcaccttcgcaattttcatgacatgtccctccaatcaactaagaacagactatatcttgattgtacattctttttgtactaggtcaatatcatcagggaaagacggaagctggtcagtacaattcactccgtacctgctgcccgggctgtttttgaagcagcgcctccagatggcgttcaaatgatgccttgtcagctttctgctttttgacaatgctgttcatgattttgacgctttcggcgctgtattgtgtatattgttttttcagctgatccagctgctgtcttgtcttcttcgcgtttttcggtgtgacttggccgatgagtttgatcatactgtctgcggtctcaaaaaaaacggctctattttctgtcagctgctgaatttcgatccggctcatgtcttgattacgcgttttttgtagcaaggcgaccgcctcgctgttttgttttttgagcgatttgttctcaagcttaatcgattcgagattctccttcgcaatgtctgcttcttcttcagtcatgttgcttcgcacgaagtattctggattaccgattccataatcaaatgcttcgctcacttgtatcatggaactgaacacaatggccagctgcctgtcgcttgcgagggcttggaaatcctgctttttcttactgctcatcggtttggctgcggtttgttttactgtcttttgatcacagtctgcgaacatctgagcctcaccttcactttcgcatgcgctcatcacaagaactgtgaccagcaggcttatacacaagcctattcgcctcatgctctgtctcctctctgctgaatcccttctggaaaataccataaaatatagttaaatggtaccagattcacctaaccccagcaataaatcaaaagtatgatttgaagcgcaaaaacataaatattttgtaaaaattgacgtgcattccattcttttcaggcccatttttcgtacaatagaagtatcgttaccggagagggggctctgatgatgaaacgttttacgaaacaagaaaacagctgggtattatatgactgggcaaattctgcttactcaattgtcgtgaccaccgcggtatttccgttattttataaatcagcagctgcggaaagcggtgtcagcgccgctcaatcgactgcctatctgggctataccattgcgatttcaacgtttattcttgcgatgctcggccctattttaggcacaatcgccgactatgaagggtgcaagaaaaagttcttcggtttctttgtgtcagtcggtgtcgccagcaccgcgatgctcgcctttatccctagtgaacattggctgctattgttgctgttttatacgatatcggctatcggtttttccggcgccaatgtgttttatgatgcctttctcgttgacgtcacgcctgagaagcggatgaatctcgtctcagcacggggttttggcttaggatacattggaagcacgattccatttatcatcagtattgctgtcatcctgctcgcacaagcagagacgattccagtgtctgtatcggccgcaagccagctgtccttcttcataacggctgcctggtgggggctgttcaccatcccaatgattaaacatgtccatcaacgctattacatcaaaaaagaacctcatattgtcatcaacagctttaagcggctcggccaaacgatgaaacggatcaggcaataccgggcacttttcctcttcttgctcgcttatttcttttatatcgacggagtcggcacgattattacgatgtcgacatcctatggatcagatttagggatcggctcctcaagccttctgatcatcctatttgtcacccaggtagtcgccgcgccgttttcgattgtatacggaaaactggcagaacgcttcacggggaagaccatgctgtacgtcgggatcgtcatttatatgatcgtctgcgtgtatgcctattttatggagacaacgcttgatttctggatactggctatgcttgtcgccacctcgcaaggcggtattcaagccctaagccgttcctatttcgccaagcttgtgccaaagcgccacgccaatgaattcttcggtttttacaacatttttggaaaattcgcctcaattatggggccgctgctcattgccgtgaccgcccagctgaccgggaaatcctcaactgcggtgttcagtctgatcattttgtttgtaattggtattgtgattctggcctttgttccggaggagaccagcgccgatgtcagccagcagcaaaatgacctgcccctttaactgggagcaggtcattcatcatttattcgctttattcaccttcagctttttccctttgacggttgtgttcttcatcactttgagaacatgagggcctttaccatttaagatctcaacgtatgaggcgttatccatgatcgtgatgatgccgatgtcgtcagctgacacaccgtcaattttggcaatcgttcctacaaaatcaacggctctgattttctttttctttccgccgttaaaatacagcttcataatgtctttattcagctcttcgcttttgtcctttttgctttccggacggtcattcagtttagctagaaattctggtttcttccttgccacttcctcttgagaaggtgcttctattttttgaatttcaaatccgatatattcttcaatgtcggctaaaaaccgtttttcgaaggccgtgacaaacgaaatggcctttcctttgttccctgcgcgtcccgttcggcccgtgcggtggacatagctttccttttcaaccggcagatcatagttgataacaagggagatattttcaatatcaatcccgcgcgcggcgacatccgtcgccactaagtaacggtactcgccacgtttaaattcattcatgacgtcgaatcggtcttcctgaatcattccgccgtgaattttatcgcatggatatcctaagtcatccaattcatcggtcagctgattgacgtgctccttcgttcggcagaaaatgatgcagctgtcgggattctccgtcatcagcacatctttcagcaatgaaaatttatgctcttctcttacttgaatcaccgcatgttcaatatttcttgtggtaagcccggccgctttgatttcgatatgctcggggttttgcatatattgacggctcagcttctcgatatcctgcggaagcgtcgccgaaaacagcatcgtcgtacgctcagtcggcagatgcttgataatcgcctccacctgctcaatgaagcccatattcagcatctcatccgcttcatcaatgaccaaataagagagacgatccaacggcagcgtgcctttttcgatatgatccagaacacgtcccggcgtgccgacaacaatgtggcttttttgcttaagctcagctttttgtttatcaaaggaggattttccaaatacggctgtcgctttgatccgtttaaatcgtccgatgttcgtgatatcttcctttacttgcaccgcaagctcacgggtcggtgttaaaataagcgcctgcggcttgttttcatcccaattcgccagctcacagagaggaatcccgaacgaagccgttttcccgcttcctgtctgtgatttgacgacaagatcctttcgttcaagggcagcggggatcacactctgctgcaccttggtcggttctgtatatcccagtccttccaatgctcgtaaaatgtcatgactgatttgatagtttttaaaatgactcatgtataaactcctgtctcttgcagatgttctcattatactctaattgaccaaggcatatgtgttttgtcgaaaaatgatgtattaaaagccagcgattccctggcgttttagctcctgaacagccaatcgcgccagtgcgtcggcccccgcgcgattcgggtgcagcgtatctccatccatataaagcccgagtgttctttccggaccgatcgatgtaaagtatgccgagctgaggacatttaagtcaatgagatatgttttttcctcttcggccaaagctaaaatagaggccctgtaccatctgtttacagacgaatggatgccttcagaagtaaaatcggttgcccggccctgaggcgttgataggatgacgtccgctcctttcgcttttacctgacgaatcatatcacgcatcatctctttaaactccgcttcagattcattatgcttcggatttgtgtcattaatgccaagctgcaatataaaataatctcccggtttaatatacttcaggatcgcctcaagctgtccatcatttctgaaccctctcgcgatctgcccgccggacgccatgtttctcacttgaaaggtgtgtttatcgatatagtgaggcagcatctgcccccagcccgcctgcttgctgctgttgagcggataataattgcacaccgtcgagtcgccgccgacataaatggttcggttcgtcaccggctgatcagacaatttctttattttcaaggcgctaagcgtaaaagcggtgccggctttcccctctgtcaccagtagattcagctgcccgtcggtgacaggaatttggaacgtatcctccgcgccatcccctgtcatattgatgacctgaaacacgccctccgccgccacactggcccttgccgtattgccaagcgtcgccttcacctcataaaggccgttcgggagatccacttgaaacgtgttattacttttcgtcccatacgctaaaaactgaaccgcatcactcttcactccagtcccagatgctgccacatccttcatattctctggtgtttgaaagccgtagccctttgaccggtcataccgattagacgccctgacaccaatataaccaggctcaaccgaaccgtttccaaagtcaaactgatacaccttctgctccgctgccttcacactctcattcccgtcaaaacccaacatcaacatcatcacaaaaaccgttgccatccattttttcatcaagactccccctctatgaaaacgcatacattaatgcatactcggtgattgtttctttatgatgactgaatgaagaaaaaaatggcgttgaggaataaaaatgaggggagagtctcaagaaggggaaaatcagtgtgacttcttgtcacacttgatcacatcccaacctccgcaatagaaactcatctgatcttcttgatcatacacataataacggagtctttcccattgatcgtcagtcggttcaatctccaactcaaccgcatcaatggattcaaggtcatccagccttgatgcactaatgtcttcaaaccgcaaatgaatgtcacaggtttgagctgatcgttttcattcaaacacaggaatatgaatataacgatcatcttctttcatatagaaagaaaactcgtttaatgtaaatggacctgtatcctcatcagaaagatgctttttcaatttctcgtattgtgtgatattcaaatgaattcctcctatttttagttacctccaaccatatagatctccgcagcatcgtattcaaaccatatgatccgttcgcctgagtccgttaggcattggagcttcccttctgaaaaatagcttttatccggttggggatcagtgatcagaaaaacatcatcattgatggaagctaacagaaagagaaaatctgcaatatcccggtctgcttcctgtaatatggattggaaatggaattcccttttgtccagcttcgtcaccttgtaagcatgaccttcaaaatactcggacaggtcttctataaatgaaccagtcgttattacctgtatcatgattcgatcgtaggcaagccctgcccaaaaacgataaaacgactctgcatctttaagttcgcatgacataacggtttggtcaggcttaagctcgatcatgtccaaattgccaatactgcttatagaggttatttccataaaatcttccccttatcagttggatagcgcaacgcaaatctcttgtctgacttgttcatacaagagaatatgatgatacagatccttatcgttttcgatcatatccggaagtatgtcaggatacagctcaaaaaagcttttctccaacgaacgccgctgttgccggggcatccttttattcgccagcacataatccaaactgccatcaacaagcataaaaaactcatagatttccgcttcaaagccgtacaattcactaggatacggcgtttcttcaagctctcgctgtctttttttcagtttttcaaacacgccgactctctcctccgacacatgttaaataacaaactaatctatcttgaaacaggataggcggatatttatctatcgcctccaacaggtcttcaccaaacacagtgattgtcaatttccacgggtctcccaaaagtccccaagagaagtcctgatgaaaaaagaaataatagtctccatttggaaatacgggaacaggccattcgccaaattcatcctgaggcattgcctgatgagggctaaacatatatccgtcatgctgccaatctagtgcgtacattacttcgttctttccagtacctaattgaaatgcttttaaaatagaagcctctaaatcactcagcactccactcacatcattatgaccagctttactgctcatcgcgcttgagatatcaaacactcgatatggctcaggcggaatgatgtgatgccatctgcttccgggtttccattttatgagcttgttcacttctgaccagatgcggtcttgttttgtctgacttaaagcgcgccaattcatcatgatctcatccctacacctattggatatcctgtttgtaaacaccagaagaggccactgcataaacagcgttacttgtcagtttcagctgttgaacgtctagggcttcaccgttcgagtcacagcatgttatctcttccatctcttgactcacatcggcagaaatcaaataaagagacgactcaagctcttcactgtaacaattgaacgtcccaaccaaaaaaccttcttcagatatcgcaagctgataaaatgcttctgagttcggctctttatccgacagaatccatacccgtctcacgaccgtgtcgtcaaacgcggcaatgactgcatctccgtaatacagcatataaatcaagccgtttttttctgcaagtccataacaatcatctacagccggcgcatccatttcttcgagctttctatcaaagtgtatttccttctgctgaccatccaaagtaaaacaccaaacactatgcccatcaggattttcatcatcataaatgccttcatcatttaaaccgacccaaaggttttgtttctcatccaaaagacagcaggaaacccctgaaggcaagtgaaaagcacttttcactcttccctcttctgaaaaaacctttaccttcggctcatacgattcgtaataaacgaagacatagccatctgcacattgttgaaagagcagaatatcactgtatgaaatctgctctttggctttaaaaacccgaatatcaccggaaggatcatagattgaaatggtcacatcatctttcacaccttttccaatgtagacacgccccagtggatcagcatggaaaaaacaatcttgggtgtccgtgttgatgactttattcatttttaattttttcatttgttatgctcctaggttagaaatgaagtgataattaagcatttattagctattagtaacggacagcctagtttcattaatcgttttgatataaagctactttccaattcagtcttaaagcatttagtatttaattggtatgcataaaacgattgatcatcaaagcgaactgtttcagcttcaatagcaatcagcattctgttcatgtcaataagaaagttagcatttgattgatactccggaattatataatttgatagattctcgattccttctggatgataactcatctcaaatacttgccaactgtattcttccggatctattttttccaatctcatgtcgccaacatctgcactataataagcggatgccacattttgaaatgatattttatgcgtatattcaccttcatcttcaaaaaccttaatatcaagtgagagttcttttttaaacacattaaaatctaaatgaagaacactgcacccctcatctatataatcaacccattcattaatcgtttgatacattgtcatcccctgcttctttttaatcaatagcgcctttccaccaagcagaaagcaaattactccgtatattgtttgatccaatcatttaaatcatctgttgaatgcaaataagtttcaggagaatctttcaaatcaattccgcttaaaaggattaacatatcccagactctaccgttttttactttagggtcatccgcataaatataagggcccgcccaatctgacacttcttctcttgttgtttgtccatttaagacacttttgattttatttatgcattctagtagttttggctcgatcaaattgatcaccacgcactcaatattcgtttggtataccgacaattctatttattttattaaagcctgctgagcaatcagatgatcaacagacaattcggtaaaagatcctctaccgaatgaattctattattcgctttgaagatccaaacaaagtatttaataaatgttattctcattaacaataattgcatttttatattcttctgctgatgttttcataaaagaaatttttttatgattaaataaagtattagtttttaaatttgcagagtatatataatcattactatcgctttttaataccaactaagttttcaatatattatatgctctattgttttatttttttcaagccaatcatagtcattaagagttgatatttcatcaaaatagtacattcacttttccttttactaattgagaaagctttttttcgcaccaagaatttgaaataactgtattattgatttaacatgttagcttcattggaataggattacaatatttttctggaacgtttatgttattttaagaatcaaaaaaaggccgcataggcctttttacattttccattattgcatttgttcaatatccgtaccctcagctgtcacattcgccttcccctgcctcctgacaagcgtcaaggccatgcccgcaaagatcattacgatgccaagcgtttgatagaggtcagggcggaaacctgtgaagacggtatcgagcacgattgcgacagcggggtcgagaaatacaatgattgaaataaatttcgttgataaaaatcgtaaactgtcaaaaaacaacaaatatacaatacccgtatggatgatgccggtagataccaccataatccagtttccctgagataggtcagcaaaagcgccaaagtgaataaacggaatcaggatgataacccctaaacccgtctgcaagaaggtggtcgtgtaaggactgagattgtgaatgccttttcccaataaagtggtgaacgcataaaacagtgcggcgagaactgcccatatgatccctgatcccatcagctgtgtcaatgaagtgctgccgttaatcccggaaatcagcgcagttcccagaaagcagatgataatggagctgacggagatcacatttaatttctctctgtagaggaagctacccagaagaagaacaagcaccggcgctagatgataaacggagatggcaattgtaacggacgtttcttcaaaagacttaaataagaacacccagttgaatacaagaaagaaaccgcacaccaatgtttgcagcacgtctctcttgctccatttttcagttttatactggccggacgccagccagcaaaggcctaaaaacagcgtcgcgcaaaggcagcggacaaagaccaattcaaatgacggcagattagtatgctctgagaaaaagccgatggagccgaaaatcaccatagagatgaccattttgattacggctgttgttgatttttgttttggtgtgattgagagatcttgctgcatcaagcgtattctacctccaattatgtatagggaaaagcaccccaactgcaaggtgcttttccttttttatagtttcttgccggccgtccagccgccgtctatgacaaagtttgaacctgtaataaagtgcgcctcatcagaagccaaatacttcatacaggaaacgatatcactcggctgcccccacgtatgaagggcatggttatctttgatcagctgaaccatttcatcgtcttgaaaatactcttccgttaattctgtttggatcacgcccggcgaaatgctattcaccctgatcccctttgatccgaactccatagcgagctgcttcgtcagtccgatgatcgcatgcttggaagacacataggcagcccgcgcaggctctgccatcagcccggacacagaggcgatgttgattatacaccctcgtttccccagctttgaccacagccttgccgcgtcccgagaaagaataaaggctgccgtgagattaatgtctatgacctttttgaatgattctgctgataattcaagaacaggggtaatttcccttatccctgctgcattgatcaaaatatccgggatcagccggcttttttcaagttttagcatcaaagattccgcctgccggacatcagacaagtctgctttttccatgtgaaactcactgtttactataaattctgacattttattcgtttgaatatccactccaacgactcgaaagccttctgttagaaattgctttaccgccgcaaagccgattccgctatttgccccagttatcattatattctttttcttcatcattttacattctgccttttttcactttggtaatttgtaataatctgaatattattatttgacaatatattacaaataatttagcattgcactacatcctctattttccacattttctatcatacaggaaattactaaaaaaaacatctactttttaaggagagattcatatggttcaagtttcaaacgtacaaaaagagttgacatccgatatttctaaatatgcttcttttttaaaggaaaacggctattcgtatatcccagcagatttctatcagcagaaaacaacagacgctgcagtccgcgaattacagcttacatatgatgatttgaaagctgattctaaaggaggcggccgttacagagcgcattcccgctacattttggctcctcactccgacactcttgaattagatccggataatggatatttccaatcaaaagaatataattatgatgatggcggtatcgtcagacaattcgaaaaaatatcagatgagtttctacagcatcctgtaacgcggcacatgatacattcaaatgtagaaatggctcgccaaaccgattttgtagattgggagaaagaagtgatcgtcgggcttcaccaagtcagatatcaagtgacacctgacgcgccttcatacagctcacccatttggctgcatcgtgacgatgaaccgcttgttttcgtccatctatttcagctgagcgaagatgctatcggaggagataacttaattgctccgtctgttaagcaaattgataaagtgctgcggctgacagacccgcttgagacacttgctctcgggcaaaaggtctttcatgcggttacaccggtcggcactgccaatagagatggtgcgcatcgagatatattattagttacattttctaacagataaaaaaagcgcccttgggcgctttttttacaaatctatcgaacaattaaaaccgggcatgttgataattgagacactttatggctgacgcttccaagcatcatttctttcaggccgctgatcccccggctgccaactacaatcaggctgacgcctttctcttttgcgtgatttagtatctcatgcgccggctcgccattcgcgtaaatggtttcagcttgaacgcctttttcggctgctttttcttttgcattctcaaggattttcaggccctcttttttaacctcgttcctgatttcatcaataaagtgttcaggcacatagacaattcccgtcagagaagaagtcgtgacgacggcttctctccccacatgaagaatgcttagttccgcttgttgctcttttgccaaatgcactgcggcatcaagcgcttttgcactcatgtctgatccgtcaatcgctactaacattttgttaaacatgctcttcccgcctttcggactgtgggtggttcatctttctcttttattgtccgcctgcatttcgttattgtcaattgaagcgcatgagttttcaaaaaattgtcagagactctctccgtttgtggcgatgacctgctgataccagttgaagctttttttcttgatgcggttaaatgttccatttccttcattgtccctgtccacataaatgaaaccgtagcgttttttcatttccgcagtagatgcgctgacaaggtcaattggcccccatgatgtgtatccgattaattcaacgccgtccgcaatggcttcgcgcgcttcaattaaatgatcacgcagatagttgattctgtaatcgtcctgaatcgtgccgtcctcttcaaccttgtctacagcgccaaggccgttttcaacaatgaacagcggcttctgataacggtcgtataaggtgttgagcgtgatgcgcaagcctttcggatcaatttgccagccccattctgatgatttgaggtaagggtttttgactccgcccagcaggttgccccctgattttgcaagctcttccggatctgtgctcgccgccatcgacatgtagtagctgaatccaatataatccaccgtatgttctttcaagagctcttcatcgccttcaaccatttcaatttcaatattgttttctgccagatagcgtttcatatatcccgggtatacgcctcttgcctgaacatctgagaagaaaagtgttttgcgctcattctccattgccgcgaagacatcctccggcttagaagtcatcggataggttgtcgttgccgctatcatacagccgattttcgaatcaggaatgatgtcgtgacccgctttgacagcaagagcactggccacaaattggtggtgtgccgcctggtacatcgcgtttaatttgttttctccttcttcaaaaacaagaccgcctccggtaaatggcgcatggagcactacgttaatttcattaaacgtcatccaatacttcactttgtgttgatagcgtttgaaaaccgttttggcatagcgttcataaaactctatgactttgcgattcttccagccgccataatttttcactaaaccgagcggcatctcataatgagagatggttacgacaggctcaatatgatgctttaacagctcatcaaacagatcatcataaaatctgaggccttcttcattgggctcctcttcatcgccattcggaaaaattctcgtccacgcaatcgatgtgcggaacgccttaaatcccatttctgcaaataaggcgatatcctctttataacgatgataaaagtcaatcccgttgtgatacagattcaaggaagtcattgattcatcaaatggagacatgatcccgttcggcgatacgtcagctgtcgaaagccccttaccaccctcgttataagcaccctccacttggttggcagcaactgcgccgccccataaaaatccttctggaaatcgtttttcatttgaactcatattgatcaccccattagttttttcaagataaagcaagcagcgcttcttttggctgcactttaccgatctctttcaccggcgaaaacgaatattggtctgtgttggtcacaatcaccggggtaatgacgtcatatcccgcggctttgatttgctccagatcaaaggacacgagcggatctcccggtgcgaccttgtcgccttctttgacgtgagccgtgaaccattgtccctccagcttcaccgtgtccaatccaatgtgtatgagtatttcagctccctgatcactcgtaatgccaattgcgtgttttgttttaaaaatggtggtaacgcttccacgaacaggcgacacaacttctccttcttcaggctcaatggcaaatccttttcccatgatcccggcagaaaatactccatctttgacttcacttaaggctttcacttctcccttaatcgggctgtgaatgatctctctgctgccctcatgcactgccggctgctggctgccgtcagaaggcacatcctcgaatccaagcaaatacgcagctgctgttcccgccgcaaacgcaatcacaaggccgatcatcgcgtaaataaacgttgggccgataaagacagggatgctcgggagacctgcattccctccgacgatataggaagcaacacccgtcatgccgtaaaacgcgccaccggctgcaccgccaatcaaagcggccgcaaacggctttttcaatcgcatattcacgccgtacatcgcaggttctgtgatccccatcagcgccgtgatgcttgtggtaagcgcgagtgatttaaattttttgtttctggagcgaaggaagacggcaaatgatgctcccgcctgccccatattcgccaaaaacatagccggcagtaaataatcgtggccgttttgagcgatgttgttgatcatgatcggcacaaaggcatagtgcatgcccgtcataatgattaaagagaatgtacccgccagcaaaatcattgccacaagccctgcatgatcaaacaaataattgaccccagaagacaagtattctcctaaaatagcgccaagcggaccgactgtaatcaatgtcagcggcacgacaatcaatagcgtgaatgtcggaaccacaatcaatttgagagatgcgtgtgtaaaacggtcaatccatttttccacgtatgaagcaatccaaatcgacagcaaaatcgggatgaccgttgacgaataagtggcagcggttacaggaagcccgataaaggaaatcggtttccccgcaccgagcagggctgtcaaatccggatgcaggatcgccgccgcaatggcagccgctacgtacggattgcttccgaattttctcgccgcactcatcgctagcaggagcggcaggaagtagaacgcaccgtcaccgacagccgtcaaaatgacatgaacctggctcttctccgccatccagccaaacgtaactgccagcgcaacaagccctttgatcatccccgctcccgcaatcgcaggcagaatcggggtaaacacaccagaaatcacatcaaagaccgcactcagcacattctttttctgagaggatgaaccagcgctcttttcatcactgagattgctgtgccgcacaatcgcctgatacaccttcggcacatcgtttccgataatgatttgaaactgctcgccgctgatattggtgcccatcactccaggcagctgctccaactgactgcgatccgccttcgaattgtcatgaagattaaaacgcagcctcgtcatgcagtggatcacgcgctgaacgttgtcttcaccgcctacgagttgtaatatgtccttcgataatttatcataatccatgtgtatacctcctttttatggggggactgctggaagaaaggtggccgcctttcaccagctttttttctatcaaatgctgcatcacctcctaaaagagaataaaaaaaacctaaatgacacagattgcgagagtctcctcctgcacctgcaccatttaggttttgcctgctttcacagtaacaatcctgacgggtcgttttatttgtttgtaggtatactttagcactagatttatcggatgtcaacgctttcatttttgagttttgactaaagggaattacttattgaggactgctttgttatagagggaagccattttgtatattttgttttatttttctgaaaatactatcaaatatatcagctgacttaatataaaagtaaaaaaccttgaaaggcaatttagcccatcaaggtatatgttttatttttgactatcccttttccatatactttctccgtcagttaaaaaaactgcacttggcggatcatcataaagtgaaatttcaactaatgaacctttcttttgtattaaccaattatataaactactttcttcactagtaggatgagctaaaatatcatttacttgaaatgtaactgcataatattcgataaaattcacatcatcgtcatccaacccattgtctgtttcaaagagtgtgtctggttcaccaataatctttaatccactatcccactctattatcaagtcactatctttatactcttttaacgcttttattaaaggatcatattccatgtatatcctcctcaagagaaaagtctctgcaatcatgccgtgagagtcagattctacagaggaaatcgcatgctgtgtttgtttcagtacttttttgtattcgtcgataaacatgccaaagaaaaggagaagggtttatgaattagctttataaaagattatttttattaaaaaaccttgaaaggcatatagccagtcaaggtatgataacaataacattatatttagaagtatcaactacttcacctactgatttatctgagagaatatcataattgttttatatattctttctaataaaataaggctattttaaagtaactccactccaacttgtttgcaaaatttaactttaagtctctcttcttgacccacattcattaccataactttgtcatctttttttatacttgttacattattaaaatcacctgtaaatactatagaatcattaaatgtaatacttagactactcgtttgcttatatacatctaaagttaaaatcaccttgaaattttggtcatctttgtaagtataaattaattctccatcatctatattgcctgttatactcaccggctcactttgaaaaagttctaatagatcatattcatcatactttataaacatttgtattcatccttttattaattatttcggtataactgtgataacatcgcctgcttcatttattattactttgacatccagtgtttcatgaacaaacgttccgcttctattaccaggtatctttttcgtattcattatagcgtcttcaataactgaaggtgaaatatttcttgggtcaacatattttttgataaaatcactaaattcttttgtttgtggtttatatcctaattcttcagcttttttaattgctctacttgttaaagtagcttttacttcaggaatatcaggtgccattctttccaaagcatgctgagaatactttcttccatttatttctcctccgccttttgacatgttccaaccaatttcacccttacccttagaagcaactttattaacctcacccttactttccttctccgcaacatgtttagccacatctgtgacaacacgcttcccgcctcggaccgccaattttttaatagcgccctgaggacttacccactcaataaattcatattgagttccggcaagaaacgaatcaattggcttagctccgcctactttatcctctggtatgtaagacacttcttctagccgctttttccctccagcatagaattctcttacgatctggccgttttcataaacataatatttgccgccgacatagtcgatgcttgcagtattgcgagttagttcgtcaatcacttctatcgtatctatcttttttaatcttttattattatatagtttatcatttatcacccgtatgtctccatagactttcgggtgagctgctgcttctttctgtaatacagttacgttactgtcatcagcatgaatctcacgctcgatcttctgttgtttgccatccttcatcacgatatcaacgttggactgcttatgtttctctattttcttcagcatcatctccatcggtgaatcatccggctgcttcatttgcgagttaatgccgccgaaggtttggttgatgttttcttcttcctgtgatttcaggatagagccgcttttgtagcctgtgatttcaattttcggaccggtatacatggttccgagctggtctatatattttttcatcgtttgaaaatctgattttgcggtttctaatgcttgggtttgctggccgtcaaattgaaagagcttattcagggtgtctgaaatcagccgctcagcctgttctgtttccatccgaaaaaaggaatcattgactgtcggcaggctgacgatgtgatcgatggctgatgtttggcgattgactgcgtcagtgagctgctctgtcacttctcgtgcatgcttgaccccatgtctcgcatcgtgtgagagaaaagcctctgcgatcatgccgtgggagtcagattctacagaggaaatcgcatgctgggtttgtttcagcacttttttgtattcgtcgataaacatgccaaagaaaaggagaaaaggcttgtggcactcctcgtaaaaggtccggatggcatctccgccttttcctttcagcgcatccctcatgcctgccagatgctcaacgcttttttccagcttctccagctgttgtttttgcttgtccagtttctcaatcgtatgctgaatgccctcgtgaagagcgtggacatctaatgttttcaatcccttgtcctcccgcgctttatttcatggaagatgatatgttttcgtccgtttccttcatggcgtttaccgcgctttccgtttgtgcgatatgcttggccagaacagacgcatatgcttcagtgagctctttgatgtccttatttaattgctcgatggacttcacaacattcaaatggtttctgcctgagagatggccgggtaaggaggacttgagttcagctgaattcttgagctgagaaagcccttgcttcactgtgccatacaccattttaatttcctgtgccatttgtgctcacctcactttttatgtttttctttctctatttcatgctctatcctcgtaatttggcgtcttatggaatagacatcgccctctaatgagtggatttttccttctatgctttcgatgattccgttgacttgatcgcttttgatttgctgatatgctttgttcattccttcacgaatatcttcaaaccgctgagcatgtgttcctctccatgcctcccggttaagatgaggccggtgaatgagatgctgggcctcggagaattcgtgtttgatttgcctgatttcgtgcagcactcgttttaattgatggatctgttcctgcttttcatgtaagtcggcttttaccgaatgtaacaacatttcactatgcatgccgcaacacctcgtgtttctatcaaactgtgtcaattctttacaatacagactattttcatattacatgatgggtcatattggataaataggtaaaaaggattgtcttgaggaactttataccggttctaaatagctaaaaattcaatttcataactttgtaagagggagaatcatcatattggggacttttcgtttaggtcttgaaccccgcaatcacttctgttttttctctcgctcaaccatttcttatagtcaataaagctcataaaaaagcgccttctctagaaggcgccttctccatcttatttagatccccatacagcctcaccgttgccattcaaaacactaaacgtcatgacgttcttctctctcaccgaatcccactggcgtaaaaataccccgttatacttcttgccagctaacgtgatgtcgactgtgttttttccggttttctgccatgttccggtcatttccccggaaatggtgtggtttttgttgagctggataatgatggtttgtttgatgtcggctgagatgtcttttccgtgctggataagtttgtatgttcctgtgatgtctttttgttttacttctttcaatgtttcgcccgcataacgatatggtgctgctaccggccagccgtctttgttcatgaacaattggtggactctgacttcgtgttcttcacccctgcccgggaagcgggtgtggaagattaaataggaacgcccggttttttcatcatagtatgcggagttgtggcctggtgagacgtacccggtgcctttttcattttctgtttcaaaagtgtagctgcccatgagtttgacgccgtatggttcgatggaacggtcgtcgaagaatgtgccttctttgccgcggacgtcaagcattggattgccttctgcatcatagtaagggccgtctggtttcttggagcggaccacacggatgttatagccgcctgttgcatcaagaccgccatatgataggtataagtagtagtatttggtgtctggattgtagagaacatacgggccttcgattctgctatggttgccgccgagcagttttttcccgtatccctgtccaggaagcgggaagcccgttttcggattcatttcaagtatgaaaatgccgcctgagtatgatccgtacaccatccacagcttgccgtctttatcaaagaaggtatgcgggtcgacgacattcggatgtttggttgcgtcatacggtgttccatcgttgcttgtgccttccattcctgatttcaaaaagatgcctttgtttttgtatgggccttcgatgttgtcagcaacggcaacacccatggcggatcttggcgaatcgccgcggcaggcgttgtagtacatgtagtatttgccgtccgccagctgcgtgacgtcagccgcccaaagagtatcggattgcgcccattcgaaggtttcttttaattctttatagacattcgggataagtgggttgtcattgcttacgctggtggtcagctgctgccattgcatgaggtcattcgatttagctgaagcgagatgagatccaaaaacataaaaagtgccgtttgtttcaatgatggaagggtcatggacgctgacttctttaaatataggtttttgtgcatagacggagtttgggagggtgaaggccatgataagagctgcaagaaaacatacacagaacaatcggttgaacatctaaacaattcgcctctcttttttattaaattttaaacgcttacatttccctatgaagataccccggcctattaaaacagccgaatgttttcatattcaaacagataggtgatttctcactgttctcttacatagtcagactgatgtctgtctgttttgcgcagaactgctgcttgcatacctctattcatagttcaacccttttgccgtttctccttcttcaattacttctgtttcttcatttgcgtacataatgaacgctttgtccggtcttgtaaagtcgtcgacttttctccggcaacttcgcctctttttggcattttacctctcattgtcagcaatatgacagcggccgcttgcacttctgtctgggtatgcgtgtgcaatgtgctgctttctgcgtcacactattacaatagcaatctaacttgttaaagactgtaaaaaaccttttgacttctgctgctgaaccaattaatataatactcagttaatagttatcagaatttttaggaattgagtgattcatatgacactgcataaagagcgtcggatcggccggctgtctgttctcctgctgctgaatgaggcggaaaaaagtacgcaggttgaggagctggagcgagacggatggaaggtctgtcttggcaaggtaggatcaatggacgcgcataaagtagtagctgcaattgaaaccacttccaaaaagagcggtgtcattcaatctgagggttatcgggagtcacatgcgctttatcatgcgacgatggaggctttgcatggcgtgaccagaggtgaaatgctgctgggatcgctgcttcggacggtgggcttgaggtttgccgttttgaggggaaatccttatgaaagtgaagcggaaggcgattggattgctgtctcgctttacggaacaatcggggcgccgattaaaggtcttgagcacgaaacattcggtgttggaattaatcacatatgaaacagcccatagatcttagacaatagggggctatgcgtgaaaacagatgttcacagcatagctcctttttgtatgggcgctttaccaaagtaaagaaaaaggagttgggcttatggtgactttagacggttcttcattgacaacagccgacgtcgctcgtgtgctgtttgattttgaggaggcagcggcttccgaggaaagtatggagcgcgtgaaaaaaagcagagcggcagtggaacggattgtacgcgacgaaaagacaatctacggcatcaacaccggatttggcaaattcagcgatgtcctgattcagaaagaagactcggcggcgctgcagctgaatttaattctttctcatgcctgcggagtcggcgatccttttcccgagtgtgtgtccagggcaatgctgcttttgcgcgccaatgcgctgttaaaaggcttttccggtgtccgcgctgagctgatcgaacagttgcttgcttttttaaataaacgcgtccatcctgtcatccctcagcaaggatcacttggcgctagcggagatttggcgccgctttcccacctggcgcttgcgctgatcggacaaggagaagtcttttttgagggggaaagaatgccggcaatgacaggcttgaaaaaagcaggtattcaaccggtaacgctgacatccaaggaagggcttgccttgattaacgggactcaggccatgactgcaatgggggtggtcgcctacattgaagctgagaaactagcctatcaaacagaacgcattgccagcttaacgattgaaggtttgcggggaattatcgatgcatttgacgaggatattcactcagcacgcggctatcaggagcagatcgatgtcgcagaacgaattcgcttttatctatctaacagcggcctgacaacctcccagggagaactgagggttcaggatgcctattcattgcgctgtattccgcaagtacacggtgcgacttggcagacactaggctatgtcaaagaaaaattagagattgaaatgaacgcagctacagacaatcccctcattttcaatgacggtgacaaagtgatttccggcggaaactttcacggacagccgatcgcctttgccatggattttctgaaaatcgcaatatcagagcttgcgaatatcgcagagcgccggatcgaacgacttgtgaatccgcagctgaatgacctgccgccgttcctgagccctcatcccggtctgcaatccggtgcaatgatcatgcagtatgccgcggcctcactcgtttctgaaaataaaacactggcccatccggcaagtgtggattccattccgtcatccgccaaccaagaggaccatgtcagcatgggaaccatcgccgctcggcatgcttatcatgtgatcgcaaatacaaggagagtcattgcgatcgaagcgatttgcgcattgcaggctgttgaatacagaggcatagaacatgcagcgtcctatacgaaacagctttttcaagaaatgagaaaagtcgtgccgtccattcagcaggatcgtgttttttcctatgacattgaacgcttgactgactggctgaagaaagaatctttaatacctgaccatcagaataaagaactaagggggatgaacatatgactgatgtaaaaaaatcaatccgtgccaacagaggaacagagcttgaatgcttaggatgggagcaagaggcagtgcttcggatgcttcgaaacaaccttgatccagaagtcgccgagaagccggaggacctcatcgtatatggcgggattggcaaagccgcacgggattgggacgcttttcacgccattgagcattccttgaaaacattaaaaaatgatgaaacattgctcgtgcaatccggaaagcccgttggcatgttccgtacacacccgcaggccccgcgcgtgctcctagcaaattctgttcttgttccgaagtgggcagactgggagcatttccacgaacttgagaaaaaagggttaatgatgtacggacagatgacggctggaagctggatttacattggctcacaaggcatattgcaaggaacctatgaaaccttcgctgagttggcgcgacagcacttcggaggcagcttaaaaggaacgttgacgctgacagcgggtctcggcggaatgggaggcgcacagccgctgtctgtcacgatgaatgaaggcgtcgtcattgctgtcgaggttgacgagaaacgcatcgacaagcggatcgaaacaaaatactgcgatcgaaaaacagcatcgattgaggaagccttagcttgggctgaagaggcaaagctggcaggaaaacctttgtccattgcacttctcggaaacgcagctgagatgcatcacacaattttgaaccgaggcgtcaaaattgatattgtgacagatcagacatctgcccatgaccctttaatcggttatgttcccgagggctattcccttgatgaagctgaccgtttgcgtcaagacaatccagagctttacgtgcgccttgcgaagcaaagcatgaaaaaacatgtcgaagccatgctggcctttcagcaaaagggctctattgtatttgactacggcaacaatatccggcaagtcgcaaaggatgaagggctggagaatgccttcgattttccggggtttgtccctgcctacatccgccctttattctgtgaaggaaaagggccgttccgttgggcggcgctttccggagatccggcagatatttaccgtacggatgcgttattaaaagagctgttcccgacaaataaagcccttcaccgctggattgatatggcacaggaaaaagtcaccttccaaggcttgccgtcccgtatttgctggcttggatatggagaacgaaaaaagatgggcctcgccattaacgagctggttagaagcggggagctaaaagcgcctgtcgttattgggagagatcatttggactgcgggtctgtcgcctctccaaaccgggagacagaagcgatgaaggacggaagtgacgctgttggtgactgggctgtgctaaatgcgcttgtcaacacggcggcgggtgcaagctgggtttctttccaccatggcggcggcgtcggaatgggctattccctgcatgccggcatggttgcagtggccgatggaagtgagctggctgacgagcggctcgcgcgggtcttaacgagcgacccaggaatgggcattatccgtcatgcggatgcgggttatgaacgtgccgttgaagtagcgaaggaacaggacattatcgtgccgatgcaaaaataaaggagtgatgacatgccaaagcaaattgatacgattctcatcaacatcggtcagcttttgacgatggaaagcagcggtccgcgggcaggcaaaagcatgcaggatcttcatgtgatcgaagacgctgttgtcggcatccatgaacagaaaattgtgttcgccggacaaaaaggggctgaagccggttacgaggcagacgaaatcattgactgttcgggacgccttgtaacgcccggcctcgttgatccgcacacccatcttgtatttggcggatctcgtgaaaaggagatgaaccttaagcttcagggcatttcatatttggatattctggcgcagggcggcgggattctgtctacagtcaaggataccagggcggcttcagaagaagagctgctgcaaaaagcccattttcatctgcaaagaatgctgtcctacggctcaaccacagcagaagtgaaaagcggctacggcttggaaaaagagacagagctcaaacagttgcgtgtcgcaaagaaactgcatgaaagccagcctgttgaccttgtttccacatttatgggagcccatgcgattcctcccgaatatcaaaacgatccagatgaatttctggatcaaatgctttcccttttgccggaaatcaaagagcaggagctcaccagctttgctgatatttttacagaaacaggcgtttttacagtcagccaatcccgccgttatttacaaaaagcagctgaggcaggcttcggattaaaaatacacgcagatgaaatcgatccgcttggaggcgctgaattagcaggtgagctaaaggccgtctcagccgaccatttggtaggtgcatcggacgaaggcataaagaaattggctgaggcaggaacgatcgccgtcctcttgccgggcacgacattttatcttggcaaaagcacatacgctagggctagagctatgattgatgaaggtgtatgtgtcagcttggcaacggattttaatcctggcagctcgccgactgaaaatatccagctgattatgtccattgccgcgcttcatctgaaaatgactgcagaagaaatttggcatgcggtcacagtcaatgccgcatacgccatagggaaaggagaggaagccggtcagctcaaagtcggccgctcagctgatctagtcatttggcaagcctcgaactatatgtatattccgtatcactacggggtcaatcatgtacatcaagtcatgaaaaacggaacaattgttgtcaacagggagggagccattcttggataagtacccttttctcagagaggccggatcttcgtttaaagaccgggatgtcacaaaaatgagcgacctgatcgcaacatgggacggccaggacattaagggaccggcgttgataggtgtccccctatcaaaatcctccatcagtcattcaggcgcttcctttgcacccggaacaatacgccaggctctgaaacattcatcagcctattctgctgagcttggagagcatgtcgtatcagagcttctatatgatctgggggatatcgatattcatgtcactgatatcgtaaagtcacatcatcacattttccaaaccatgcacgctctgctttcggaccatcccgattgggtgccgctcatacttgggggagataactctatcagctactccacaataaaagcgatagcacaaacaaaaggaacgacagcagtgattcaatttgatgcccatcacgatgttcgcaatacggaggacggggggccgacaaacggcacccccttccgccgccttttggatgaagagattattaaaggccaacatttgatccagctcggtatcagagaattcagcaacagccaggcctatgaagcatatgcaaaaaaacatagcgtgaacattcacacgatggacatgatccgggaaaaaggactgatcccaacgataaaagagattttgcctgccgttcaagatagaacagatttcatttttatatctgttgacatggatgtcttagaccagtcccatgcacccggctgtccagcgattggcccgggcggcctctatacagaagaattgcttgaagcagtcaagtatatcgcacaacagcccaatgttgccgggattgaaattgttgaagtcgatcctaccctcgattttcgagatatgacaagcagagctgcagctcatgttctgttacacgcattaaaaggaatgaaactctccccattcaagtgatcttctggcaggttgtattttgggtataagaaactcatctgcctaatgaatggcagctaaaaggagggcgagacagtgaatcttcaggagaacagcagccaacagctaaaacgcacaatgaaaagcaggcacctatttatgatctcattgggaggcgtcataggcacaggacttttcctcagtacgggctatacgctacatcaagccggacccggcggtacgatactcgcttatgtaatcggcgggttgatgatgtacctcgtcatgcaatgtctcggcgaattgtcggttgccatgccggtgaccggctcttttcaaaaatatgctacaacatttattggtccatctaccggttttatggtcggcatcatgtactggatcaattgggtggtgacggtaggctctgagtttaccgcatccggtattctcatgcagcgctggttccctgacagcagtgtatggatgtggagtgcgatttttgcagcccttctttttatatgcaacgcattttcagttaagttatttgcggaaactgaattttggttttccagcgtaaagattgtcaccattattttatttatcattctaggaggagccgccatgtttggcctgatctctttaaacggaacggcggatgctcctatgttgtcaaacttcacggaccatggcgggctgtttccgaatggctttcttgccgtttttatcgcgatgatatctgtgagttttgccttttctggtacagagttaatcggcgttacagcaggagaatcagcaaatcctcaaaaggatattccgcgatccatccgtaatgtcgcatggagaaccgtgatttttttcattggcgctgtcttcatattatccggattgatttcgtggaaggacgcaggcgtgattgaaagcccttttgtagccgtatttgcggagatcggaatcccttacgctgctgatattatgaatttcgtgatattaacagccttgctgtctgtcgccaactcaggcttatatgcttcgacccgtatgatgtggtcgttagcaaatgaaaacatgatcagctcccgttttaagaaagtgacctctaaaggcattcctttaaatgccttaatgatcagtatggctgtatcttgtttatctctcgtttccagtatcgtggcccctggaactgtctatgtggtgatggtcgcaattgctggatttgcaggagtcgtggtctggatgagcattgccttgtcccaactcttgtttcgaaagagatttctgaaaaaaggggggaatgtaaaagatctgacatttcgcacgccgctttaccctcttatgcctatagccgctcttttattatgctcagcttcttgtattggtcttgcttttgatcccaatcaaagaatcgcacttttctgtggagttccttgtatcatcctttgctatctgatctaccatttcaaaagaaatgtttcaaaagcgaaaaaaatcagccaagaggaatatccggccgatcacatcctgtaattaaaaaagcacaccccgctcaggatgggatgtgctttattttttattcagtaatcaacgtatgaatcagcttcggcgccttcgcttccgcggcgaggcggatgttgtcatagacttttgcgatgacttcatcgacgttttcgcggttggcgtaaagcgtcacgagcggttcgcctttttctactttgtcgccgacctttttgtggagcatgatgccgacggctaaatcgatctcatcttcttttgtggcgcgaccggcacctaacagcatcgccgcgacgccgatttcgtccgcaacgatttcagagacgacacccgcttctttggcaggcacatcaatttgatatgcggcttgcggaagcttagacggatcgtcaacaattgagctgtcgccgccttggtttttcaggaaatccttgaatttctcaagtgctttgccgtttttcatgacttcttccagcttcgctctcgcttcgtccaatgtatcggcttttttcgcaagcacaaccatctggctgccgagcgttaagacaagctcatgaagatcctcgggtccctcgcctttgagcgtgtcgatcgcttctttgacttcaagcgcatttccgatcgcaaagccgagcggctgggacatgtctgaaatgacagccattgtttgacggccgacgttatttccgatgcgtaccatcgctttggcaagttcagctgcgtcttcttctgttttcatgaaggcgcccgctcccgtttttacgtcaagcacgatggcgtccgccccggcagcgatttttttgctcataatcgagcttgcaatgagcggaatggaattgaccgttcccgttacatcacgaagcgcgtacagttttttatcagccggcgttaaattgccgctttggccgatgaccgcaaccttgtcgcggttcacaagtttaataaattcatccttcgtcagttccacgtggaagccgtcgattgcctctaacttatcaatcgtgccgcccgtatggccgaggccgcggccggacattttggcaaccggtacgtcaagagccgcaacaagcggagcgagaacgagtgttgtcgtgtcgccgacgccgccggtggagtgtttatccactttaattccttcaatggcagaaagatcaatcgtttcaccggagttcaccatagccatcgtcaagtccgcgcgttcacggtcactcatatcctggaagaaaatcgccatagcaagcgcgcttgcctgataatcaggaatgcttccgtctgtatagccgttcacgaaaaattgaatttcttcagtggtgagttcttttccgttttgttttttgatgatgatatctaccattctcatgtttggtcaccgatccttttcgattaagttcagtaaatcaagcccacaattgctgctgataaaaagctgacaagcgtagcaccgtataataatttcaagccgaaacgagcgacgacatttccttgcttttcattcagtccttttacggcaccggcaatgattccgattgaggagaagttcgcaaatgacacaaggaataccgatacgatcgctgttgtacggccgctgaaatggaaaccgttttgcgtaagcgacgtcatggcgacaaattcattcgataccatttttgttgccataatgcttccagcattaacagcttcattccatgggataccgacaagaaaagcgaatggagcaaacacatatccaagaatgccttggaacgaaataccgaatactgcattaaaaatgccattgatcaaggcaataatcgcgacaaatccaatcagcatcgcagcgacgacaaccgctactttgaaaccgtcaaggatgtattctccgagcacttcgaagaaggattgtttttcttcttcctcaacacgaagcatatcctcttcttttgcaacctcgtacggattaataatagaagcaattatgaaaccgccaaataagttcaagaccagcgctgttacaacatattccggtttcagcatggtcatatacgcgccgacaatcgacattgacacagttgacatcgcagatgcgcaaagcgtgtacaagcgctgctgatttaaaagaccgagttctttcttcaaggagataaatacttctgactgccctaaaatcgcagaagccactgcgttatacgattccaatcttcccataccgtttaccttgctgagggcaaggccgatatatctaatgataaacgggaggactttccacttttgcagaatcccgatcagagcggaaataaacacgattggcaagagaacattcataaagaatgtcgtttggtccgcattcaccaagccgccaaacacaaagttaattccctcagccgcgtattcaagcagataaccgaatccttttgcaaatcctcccacgagaaaattccctatcccggtattgaggagaatgtagccaagaataaattgcaaaatgagcataacaacaattgggcggatcttaattctttttttgccgctgctcgcgatccacgcgaggcctaaaaacacgattaaaccgataatcccaatcaaatacttcatatgtgtttctcctttatttgtattcgcttacaatcactgtttcctcagaaaacggaaagcagtctgccttccgtcagctcttaatagttgtctccgcctgatgcattttctccttttacgatagaaacgcctgcgctggcgccaattcggcttgctccggcctctaccattgtgtctacatcttctttcgttctgacgccgccagatgctttcacgccgatatcaggtcctactgttttgcgcattaaggcgatatcttccttcgttgcgccgcctgtagaaaagcctgttgatgtttttacgaaatccgctcccgcagacaccgctaaacggcatgcacgttctttttcttcatcagtcagaaggcacgtttcgataatgactttgacaagcgcttttccggctgcagcttccactacaccgcggatatcagcttccaccacatcgtcttccttgtcttttaaagcggcaatattaatgaccatatccacttcagtggcgccttttgaaatggcgtcttttgtttcgaatgcttttgtttcagttgtattggcaccgagcgggaagccgatgaccgtacaaacgtcgactccagttcccttaagctcttttgcagcaagctccacccatgtcggattgacacatactgaagcaaatttgtatgttttcgcttcttcaattagttttagaatgtccgctttttgtgtatgcggtttcaaagctgtatgatcaattatgttggctaatgacatccttcgcacacttccttttttgttaagatattttttagcataaccgacttttgaacatatgtaaattggtaattgaaattttgttcaacgaaaggtttgaacgtgtcacaaatcattaacaagcgccctcgcggtatgctggtcaatgattaaaacgttggcatattttccggttaatgctccgtgaatggaagatacttttctgcttccgccggcaactaaaatggagcgttccttcagcctgaggtcttcaagctcaacaccgatggtccggtcattgatggcgctgctgcaaatattccctttcgcatcaaaaaagcgtgaacaaatatcccccacggcctgttttttcagcagggctttctcttcttcgttaaaatatccgagtcggaacaacagcgcttcatcacggacagtccccaccgtgaagagagcaatattcgcctgctttcccatctcgatgatccgctcaatatgacggtctttctccaccattcgcttcacatccgcattatcaaacacgacgggaagcggaagatagcgcggcatcgtttgaaaagcctctgcaaacagctgaatcgtttcagccgaatacgtgtttacccgggaatggctgatgccgccttttagctggacgacctcgacgccttttacctgcttcggttgcatgttttgcgcgatttgatacatggtggttccccagctgacgccgacaatgtcgccgtcttttaccgtttcatgcatatattctgcaccatagcggcttaggtcatgtgtaattcctgcataatcgggtgtcggggaaaacacaacatgcgcctcaaggagcccgtatttctcttcaagtatggaaccgagcgcatccaaatcctcaaaagggtccatgacgcgaatctggacataccctttttcctttgcatattgcagcagccgggaaacggttggccttgaaatgttgagctgctcagcaatttgctgctgactgtagtcagactgatagtaaagccttgccgcttctatgcttaattgttgtttttcccgatccattccgcacctccctgtggatcagtcctgataaaactgcttttgatttgcttttattatacaggctggcgccggctttcatccacctgatttctaagaaactgaaaaacgctctgggcgcggacctgcccagagcttacttctcccaagtcatatgctgataaatgcctttcataatggcgtacattccatataggatcaggcctaatgccaatatagacagaatcaatttgccatgcggctgctgcgcgagttcggcgagcgcgccgtcaaagcctcttgtgtcgtcgggatcagcggtcatggctgtcttgatgagaaaatagccgatggctgagaaaataatggcgcgggcgatattgcctgcgcgcccggtgtttttcgtgatgcatatcatctgtttgttcatttttgatgtatcgaattctttcataaaagcagcccgaacgcctttcataaattgaacaatcgcaaatacgataaaacccgcacccgtaagccctgtgagccatcggccgaatggctgcgccaatacataagcggaccacgtctgttctgaagtgccgccgtccccttggccaaacacaaatcgcaaggcattccaagcgatggatgtgtaaacggcggcactgaaaaagtttcctattctccgtgacaggcctcgcctgctatttccgtgcccctccgtgtccttgatcgcacttaacaccatccagattacatagccgataaggccgatgcctattaaaaaaagcaatagtgacccatacggcatgcgtgatagcgtttggagagctccgctcgaatctttggcgcggcctgccccggcagccgtcataaaagccaaaaccccaagcagaataaaaacgccgccgaatgcaaaataaccaagcctcccgaatcgtttgatccaaggcttggtttcctgttttatttttgacatgtaccggtctttcaccgccatgtgtccaaccctctttcacagaaatctttactgtaacattcccgattggacaaagttgaaacagcttctgcctcagctatggctggctgagatatgtttttgctgtttagctgattgtgcaggtgtcatccaagcagccgctgcggcagctgtgactccgcctgctaatttcccaatgatcatggccgccgccatttcttttttcattccagccacaaaaccgaggtggctgccgagtacaaaagcgccgctgaccgcaaacgcgacattgatgacctttcctctcggcgtcatatcctttaatgaagccagcattgggatatggtgcgccaaagaggtcaccaagcctgcagttgctgtctcatctaaatgaaggcatttccccagagcctgtagcggttttttaaaggtttttgtaataaaagccgtcattggaaacgcccctgccaaggcaatggcgatggtccctgttgtttgtatccctgtctcgacattctccattcccggaatcagcacaataccggtcatcgtttcaacggagacagctgcaagcccgataatcgcaaccacactgaccgctttcccgaagagatgaaacaactgaatcatactgtcggtgtatcgccataacccaaaagcgatcacagcagataacagactcgggatcagaaggtttttacctatcatgccgatgtcaaagcctgcgcataatccgccgattaagcaaccgatcggcactgtgcacagcccgattaatatgcctttcgcaaaatacggatgatcctctttttcgatgatgccaagagcgacgggaatcgtgaagacgattgccggtcccatcattgttcctaaaaacacccatgaaaacagcccggcctgcggatctttcgccatttctccagccagcgcatatcctcccatatcaatcgccaaaatggtgttcgcaaaggaagaagggtccgcgccaatcgctgtgtaaaacggagcaacaatgggaatcaggattgctgccagcacgggcgccagcgacacaattccgatcatggacagcgccagcggccccatagccttaaagccgtccgcaaaccgctcgcctagcccccatctgtttcccaaacaataatccgccgctccccatagtaaaaaggcagccaaaatgaatacaaccgtgtcattcaccgtcatggttttctcctttttcaaacgtatgattggttttatcatatcatctgaaatcaccgaatagagttgatcttattcaatatgagctaaaaattcttttatatcggctttttcaacggctgttatgatgctccgcgctttttcttgcgggaccgttaatgtcaatttttctattatgtcttcttcagacagctcatttcctggcgccccttttgggcagtccacacgcgcttcgcaaatccggccgtctgataaataggcccggacaatcgtgaaacggccttttggaacggcatgaggagccggctgaatagcattgtcatatacgcgctgaattcgccccattgtcgtttgaaccccgcttgggatcggctggctgctgaaatgttcaacggtcaggccgtgtccatgcaaagcaagagcaatcacatattcaacgctgaaacggccttcctctccagtttttggagatctttccgtcaatgcagcatctccgcctggcggaaatatcacttcaatacgttcggtattggcagcagaaatggtttcttcggagataagctgtcgtaccgcatctgcagcatggtgtgccgcggaacaaaatggatagattttaaaccatagacccggctgcacaattctccacggtgccccccaatcgtttagcaaagtgtgttgtgctttctcaacgtcaccgtacagactgaagaaaccagtttctccatcaaatgccgtgcgggacccgccaaattctgattgggccagcttaacggccagcaagccagcctgagccgccaaaccggcgtgcagcggtttcatttctgttccaaattgcaccctcatcccagcagattgcgtagccgcaaaaccaattgctttttccagctcttcctgagtcagctcctcagcataacctacggcgcaggcagcagcgatggcaccaagcgttcctgtattatgccagcccttttcatagtggcggctgccaattgattctcccagccgtgccatcacttcaacaccaacaatataagcgccaagaagccgctcgtcatgtccgcgagcggcagatgcaataagggccggtacgatgactgcactggggtgtcctcttacatcggagtggacatcatcaaaatccaatgcatgggcgataaatccattgagcatcgcggattgtaatggcgcggcctttttgccctgtccgataataggaacaaggggcaggcctccttcatcctctatcagacggaggagcttttgaattcctttatcttctcttcctgcgaatgaagcggcagtaaaatcaagtaatcccttttttgcttcgtgaatcgcgtcaactgaatgctcaggttgtgacgttctcacagcctctgcaagacctgctgtcagcccttgtttgctcatttgatggtctccaatacaataaccgccagctccgcaaagtattgagaggcaaccgtaagggcttcttcatccagtgtaaaggccggatgatgccactcctccgtcccgttcgttcccatccagacaaaaaatcccggaatcttctcttgatacagagcgaagtcttctccgcccggagactgctcagcgtgaacggtttgatagccaagccgtgccgcagcttcggatgccgcattcaaaaatgtgccgtcattctgaacggaaggcaaataaggaaaccacttgaattctgcttgtgccccatagcccgctgcaattcctttagccactcgtctcatatgctcgggaacagcctgcctcgcttctttttgaaaggttcgaaccgtcccttccatttcagcttggtctggaatcacgttccacgacgtgcccgcctgtactcttgtgatactgacgactgcgttttgcagtgagctgatattgcggctgaccacagattgcagcccgctgatgatttgtccggctgcagcgattggatcaatactgttatttgggatgccggcgtgtccgcctttccctttgatgacgatctcaaaccggtcaacacttgccataagcggaccttcctttacaccaatggttccgacaggcagatccggcttattgtgcatgccgaaaatcgcggaaatgccatcaagtacaccagcttctatgacctttcttgctcctgcggcaatttcttcggccggctgaaagataaagcggactgtacctttcagctcggcctttctttgattcagcaacatcgctgtgccaataatagaagcagtatgaaaatcgtgtccacatgcatgcattgtgccatcaaccttagatgcaaatgggagattcgtctgttcttggatcgggagcgcgtcaatgtccgctcgtattgctatcacggggccgtcttcccgtcctttgatttctgcaatcacaccagtctccaattgaggaacatcaagtatttcgatttgctcctcctcaagccagcggcggatttttttcgtcgtttcaatctcttgaaatgacagttcaggatgttcatgaagatcacgccgcatattgattaaacgggtatgaaacgttttgtcggccattgttcttctctccttcttatataagctctgcaggctctcccacctgcttgataaatcgtttcgtccgttcgtttttcggatggtcaaacaattcctctggcgttccctgctcgataatatggccgtctgccataaaaatcactttatcagcaacctcttttgcaaacgccatttcgtgtgtaacaatgatcatcgttgtttgtttttccgcaatggacttgatgacctgaagcacccctgtgacgagctcagggtcaagcgctgacgttggttcatccagcaaaatcgcatgcggattgaccgcaagcgcccgcgcgatgccgattcgctgctgctggccgccggacattgtgatcggatagctatcagccttatgctccagaccgacttgtttcagaatctccattccaatacgtttcgcttcgtcgcgtggtttatgttgagccacgattaaagcttctgtaatgttttgcagagccgttttatttttaaacagattgtagttttgaaagaccatggccgtttgctggcgaagccgatatgcttccttgcgtgtaaacttttccgcgttcagtttggcttctccgatttcaataagtccttgatccggacgctctaataaatttaagcaccggagaagcgttgactttccggaaccggacggaccgatgattgccaccacttctccgcgtttcacttctagatcgattccgtcgagcacgacgagatctttaaacgctttgcgaatattttttactgttatcaactgatttcacctctaagtccggtatggcttgctcatggcacgttcaaacaagtcctgcaacatgctgtagatcatggtaagaacccaatagacgatcgcaaccgccaagtacgtctcaaaatatttgaggtttcctgaagcgtacatcttcccttgggcgaacatctccatgacccctaatgtaaaggccagtgacgtttctttcaggagcccgataaatgtattgcccgttgccggaatcgcatttcggatcgcttgcggcaaaataatccgtctgtatgcctgaaattttgtcataccgacagacaggcacgcctccagttgcccgtcatcaacagaattgagggcagcccggaagatttctgccaaatatgctgcattttttaagcttaacccgatgatagcggctgtgagagctgtcattttgctcatctctggaaatagctgcggcagcccgtaatagattaagaacagctgcaccagtgtcggtacgcctcggaaaaaggatatatacagctttgacagctgatgaagcactggaattttgttctttgtaatgagtgcgagaataagtcctccgataatggcaaaaatcatagctgctatggccataaacaacgtgatcggaagggcctgaattaaagtcgggaacgctgatatcatgaattcccaatcaatcgtgttcattctggtgagtcaccgccgtttcttaatgcttctgttctactgtgatatcttcattaaagtatttttcagagagttttttcagtgttccgtctttacgcaattcatctagcgccttattgacttttttgcggagcttgtcgtgcgcatcgtccttggcaaatgggaatgcaacctgttcgtaaacaatcggatctcctgcaagctttaatggcaaaccggtcttcttgatttgcgcgatcaatacagttcggctgttgacataagcgtctacacggccgtacgcaacatccttcagcgtaccctcttgtgtttcgtacgttttgatattgatttttttatcaggatctttgctttcaaggtttttcgcgtggtttgaaccgagaacggctgcgactgtcttgccttttaaatcgtctactgatttgatgtctgtattgtcttttttgacgacaatctgtgttcccgcataagcgtatggtttcgtaaagttatacgtttccttacgttcgtctgtcacagctacctggttagaaatggtgtcaagcttgcctgtttgaagctcccccatcagcccgctgaattcaagcagcttccagtccagtttcatgtcaattttcttagcgaccgcttccatcacttccacgtcaaaacctgtcagctttccgttttctttataagcaaatgggtaactttgtcctgtcgcaccgacatgaagcacattgtcatcctctttactgctgctgtttccattgccgcaagctgagagcaccgctaataatgcagcaacgaccagcacaatccattttttcattttcatttgattttcccgccttttctttttttatagatcatgtcgcaattgttttttcatatagactgtgatatgcccttttccaaggtcttgttcacctgagcggacatacccttttcgttcgtacatctctatcagccacggatgcttatccgctgttccgagtgagacaaacggaacctttaacgtatcgcgaaggattgtttcctccagccattgaagcagctttgttccgattccttttttaccggtgtcggggtccacagcgaaccaccagatatgcggaacgccatacggtcccggctgttttccccaaggcattctcaaggtgatggtcgcgatgatccgcccgtcttcttccatgacgtagcaagcgtttttccgaatattttgcagcaccaaatctaaatccgcatgagcagcagcaaaacgaatgccaagctttcgaatcggttcataagcccgcaatgtcagcgcgaggagctgttcagcatcacgttcaactgcaaggcgatattgtggcttcatctagcgttcctccttactttgcatagcggtttaccggcttttccaaaccgaagtgctctcgtaatgttgtgccttcatattcttttctgaacacgccgcgctcctgtaaaatcggaactacttgatcaacaaacacttcaattccttctggaagaagcggaggcatgatgttaaacccgtcacacgctttcttatccacccattcctgcatcttgtcggcgagctgctccggcgtgccgacgaagatatggtggcctctggagcctgcaacgtatttgtaaagctctcgtatcgtcatattgtccctttcagccatttcctgaacaagcttgaagcggctcttcaccgcattagaagcttctgcgtcaagcttcggcagcggcccatcaagcggatatgccgacaaatcaattccgcctaagtaattttggagaatttgcagaccgacagatgggataatcagatcttgaagctccttgtatttggcttgcgctgcttcttctgtatcggcaatgattgggaaaatacccggcatgatggcaattttttctggatcacgtccgaattccgctgcctgttctttaatggattgataaaattcctgagctgattccaggtggttttgtgctgtgaagatcacttctgctgttctggcagccaacgcttttccgtctcctgatgatcctgcctggataatgaccggctggccctgcggcgttcttgaaacgttcagaggtccgcgaaccgagaaatattctcctttgtggttcagctcgtgcattttttctttgtcaaagaattcacccgtttctttattacggataaaggcgtcctcttcccatgaatcccaaagcccctttacaacttcgacaaattcctctgcccgctgataacgcaaatggtgttcaaggtgcttttcaccgctgaaattcagcgctgttgattcaatagatgaagtgacgacgttccatccggcacggccgttggacagatgatccaatgacgcaaactgtctggcaatatggaatggctcgctgtatgtagtggaggctgttgctgtcagtccgatttttgatgtgacctgcgccaaagcagagagcagggtgaatggctcaaaccttgttaatacatttggatgtgatttgctgtcaattgaaaggctgtccgctaaaaacagcatatccagcttgccccgctccgctgttttcgcaagctctttaaaataatccaaattcatgctcgcatctgagggcgcgtccgggtgccgccaagacgcaacatgatgacctgtacctgctaaaaatacccctaatttgatttgtttctttttgcttgtcatgacgatactccttttatcatgtttttaggctgaataatccgaaaaataaactcctatattcctagtcgtttaatatgaataaatcaaaatgtacctttgtcttggacgtttgtcaatgagttaagattaattttttctattcaagcgaaaagacccttgcgtgaccatgagggaacggcattgattcattcaactagtgcaacctctatatcggcaagaaaactgagtctaatgaagcaaagactcagttttcacccaagaattttatataagatttcgccatttcctttgccttttcttcgcttttgcaaaccgcctatccattcagacgccgtaacgattgtataaaaaaacagctgactccagatattcaaacgggaatcagctgattgatgtgaattaattaagctcatgaatactttcttctgctttagcagaaaactctttaggctcaaggcggtctaggtcttcatgaaataaactcactttttggatttgccgattgtcatagtggtggaaatagtagtttccagtttcgttgcacatcacggaagtatattgcgtataatgaatttcgtcttcttccgttatcactgcgccctttggtatcgtcatatttgccaaaatttgaaaagcggctgttacacctttcgtttcatcggccgccggctctagatgttctttcaaataaacagctctgacaaaccgggaaggcggtgtataatcccccggcagaccaacagttcctaagccttggccaaaagcagaaagggctaatccgcccatctctttgctctctaattgcttcggtctgattcctgtatattgctgcagattggttacatgccatataaagtcggggctgttcgtcatgacaccaggttgattatcatagactttgaggccgtctgctcttggttctatcgtcaggcttcggcccgtccggtctgacaatatccagtgaagcggtaaaactgtatccaatagatctaattttttctctacaatcgttaaagatcgaatcttttcttttacgtcttccaaagactgacagactgacagcacccatgtcacaaactcatgcgggacaatgtgaacggtatcttcccgtatcgttttttcgtactccgcatagcccggaaaataaagcgccgcacaagataaaccgctttcattaacgccgtcggcaaataatatatttccaagttttctccccataccgataaacgcgtactgtgtctgatgggcctttccgtcagcttcactcttccagctgtaacggcgcggatagagaatgacctccgtccccagctgaaatgcaaaatccattgttctcgctaataaatgattccggtcagcagtttccaatgtaagacttgtgcacatttgatcagtccccttttcaattcagattaatatcatacatattgtgaacgaattggttttatcagcataacgaaagtcaaatcgattcgtcaaagaattgacattacatcaaataaaacgaaaaaatccagccttctaagaggctggattttttattatttagccaaaacaagctcgtgaatcgcatgtgcaacgccatgttcattattggagcgcgtttgaaagtttgcggcttccaatacttctgggatggcgtttgccatggcaaccccgcagcccgcccattcgatcattgtcaggtcgttcccgttgtcgcctatgcacatgacttccgcctgttcaattccaagcagctgtgccagctggcgtacagcatttcctttgctggcttccgagtgcagaatttcataaaagaaaggcgcacttctgaccattgtatatttttctctcacttctttcggaatcgatgtaatgacgcggcttaagttctccggtttatcaataaacatcactttcgggatgaggatatcttttggcacctcgtcaattttgcggaaatgaagcggcacctgtgtcacataggattcgtatacggtaaattcgctaatgtcccggttaggcgtatacaaattagatgagtcaaagaaatgcatcggcgtcttcagctctaagctcaggtcatataatgaagccaaatcatcataaccgagagacagctctgagaccacttcatttgtatgcgtattttgaacaagtgctccattatacgcaataacatagtcgccttcttcaattaaattcagttcatctaaatatctctgcacacccccgataggccggccggtgcaaagcacaattttgacaccttccgcttttgccgcgtgaagggcgtcgcggacctcctctgttacttcatgatgatcatttaaaagtgttccatccatatcaattgcaattagtttgtacatcctgcatctccttcatgtcgttttcaggctatagtcccatcatatcgttttttctttttgatattcaaccggaagagatggttttctccggattctgtttagacgccgcccttgtcttcggatacgcaagcgcggtttccgctttctttctgccttgacgccgttttctgcttttttctgtttcatcagcagaaagccggcagctagaaaaggaatgccggttatattcaagatggcaagcttcacacccgccgcgatgaaaaagaacccccatgaagatgatggattccgtctgatcatgacgtaagccgccatttccagaacgatcaggatggcatgaagcactatgccataaatcagcaatacaagggcaaaaaacaaaacataattcacgattgcccctgagtacatcatagcgcgcatcatttgtataaacgataaggactgcatggagccgctgatgacattagggttatagatcgtatagtcactaaataaatgtttgactttgagaaaagcccataatataaatatccattgaatgatatgtaaaacaagccccgctgccaccagtctttcagctttttgatttctcatctttctcctccctgccggtctttgattcgattcttgtcatcgtttttctctgtccattttgctcccatatcaatgtcccgttttctcctcttttcagcgtgcttttgagcggataataggggccgaggtactgaatctcgatagacccgtcagtgctttgggaaatcaccttgtatgccataaaaggcagctgtacctctcctcttccttcaatcacttccgtttccacaacctcgtcttcggtaaatgtgactgttgctgatttcacaccgtccgttggcccgggggcacgcccctcatcccacgttccgtaataaaacggcgtctcttctttttgctgctggcagcccgataccatgatgcatacagcaattaaaaacaaaatgccatatttgtttctcaaggggatcaccattctttcctccttttttgggcgaatgccgtgccactgtgccaatgactacataagttataaggaattcacccacaaggagactgatcacatgaacccttatcaatattacagccctcagctgcctcagcaggaaccttactatagccactatgagtacaatccttatccgcagcaggatgtatacgatccataccaaatggacagacagccggcattggaaagaagaatcgcagcacttgaacggcaaaatgaacagcagtcaagagaattaacccgtctgacaaacgaagaccgccgtcaaaatcgggaaattgcacggattgccgaacaggtcaatcagttaagccaggctgttgaacgccatacacgccgcctaaatcggctcaatcagcgcctccgtacagtagaaaaccggctgaatatcccatttactgcaggggaaggcggtttctgagcgaaacaaagaaaaaaagcggaatacgattctcccatctcagggtttcgttttccgcatttcttatatgttaaaacggaacatttacataaaaagggtttgtacccagtatacaatctttaccgttttcattcaaagatagaggggctgaggaaaataattgtagttcctctttgacggaatttcttttcattcaagttgcatgataataccgactcacgtcaatcgatacatggagggatcattcatgcataatacacaacacggcttgcagcagctgaaccaatgccgccaaactgctcagcagctcattcagcaaacacagcaaagcagccagcaatatcgccaaatgcttcatcaggaacagcaaaacatccaaatgctgcagcagattctaaaccacgaacaacaagctgcacataccattcagcaagcactgcacgggcatgatatggcgattcaaaagtgccagcaggttgtcaacatgtgcaaccaaatgcaacaggaacttactggacaatccagcgtcatgaatacgaatgtgtctacacttccattcggccaaaacacgccatttcagcagcaatcctatcagcagtaacatataaaaagctcaacacaatgcgagtgttgagctttttttcttactgttctttgcgaatatgtatatcctgaatagactgtttcggtgcatgaaatctgctctcggcttcacttcttgcctcggcaaaagcccgcgcctccacatgatctttgtagacatccagctgaatcaaatacagcgggcgcactttaaatccatgaataatggtcaccgcccataacgggaccacaataaaaacaccgggcagatcgggcaaaacaaaaccaaacgcaaaaatgaaaaaataaatgatgccgtacatgatccactttctatttctaaccttgatgccaataaataaaaaggcaaaaaaactggtaatggcaaaaggcatgaaaataaacagcatccaccagctatgcagccattcccaagcggaacctctttttgtaattcccatatttttctcctcctatttacctataataatcgattaggcataccgcgtcacccataaacgggaaaaactttctcccttaaaaatagtgatagacggggaacaggtttcttgctatattattaattgataatgataatcattactaatctattgagatacatagtgggagggttcttgatgaaaaagaacatattgctcgtgggcatgcttgtgctgcttctcatgtttgtcagcgcttgcagcggcacggcttctaaagggagctcaagcgattctgcttccgaaaaaacagaagtgagaacatacaaatcaccaaaagggaacgtcaacattcctgcacatccgaaacgcatcgtcactgatttttatgccggtgaattgctgtctgtcggggccaatgtggtcggctcaggctcatggtcatttgataatccgtttttaaaatcaaagctgaaaaatgtgaaggatgttggtgatccaataagcgttgaaaaagtgatggagcttcagcctgacttaattgttgtcatgaatgaagagaatgttgataaattaaagaaaatcgctccgactgttgtcataccttataacacagcgaaaaacgtagaagatacagtcagcatgttcggagatatcgccggatcgaaagacaaagcaaaatcctttatggctgactttaacaaaaaagcggaagcagctaaaaagaaaattgccggcgtcattgacaaagatgcgaccttcggcatttatgaaaacacagacaagggcgaattctgggtgttcaatgacaatggcggacgcggcggccaagctgtatacaatgcacttgggttaaaagcgcctgaaaaaattgagcaagatgtcatcaaaaatggagagatgaaacagctctctcaagaggttattcctgagtatgccgcagattatatgttcattacggattacaacccgaaaggcgaaagcaaaacactcgacaagctggagaattcctctatttggaaaaaccttgatgctgttaaacataatcgcgtgtttatcaatgactttgacacgttctacccgtacgacccgatttctgtcagcaaacaggtggatatcatcaccgacatgctgatcaaacgggccgaagaaaataaaaaataaaaaaacggcacagtcatgacgctgtgccgttttttatgattcactttaattttgattgtacggagtccggcatatcttcaaacttgacttcttcccaagtctcgacatactttcctttcgccttcaccttcaaatacgcgttcttccgaagctctttgccggcgaaaaaggtcacttcttctttttttccggatgcattatatccgtctaatgtatattcagtaccgcccggactaagatgtctgccatctcgatcaatctgaacatagacatcttgctggtgaataaacggattaaatctgtctgtaacatcgttatgaaaaaagagaagcccgcatattacggcagcagccgccaagacggccaggattgccattgcttttttcatctttgcactccccttacttgttcatttttttcaaatagcttgaccgcaccgcgaggaagaatagaagctgaaaaatgaaaaaccctccgatggtgagactgagcggccccgcgacatcagaatagccttccacagccaatgttctcaaggcaaacagtgtatgcatgacggcaatgacaaatggaaagaagaaaagaatggccaattgtattgtcacgctttgtgccatttctcgctcactcagaccgattttggccagtgaacggtagcgctcccggtcttcatctaaatcagtgaacagcctgaaatataagaaacttgctgccgcgacaaagaatacaattgcgataaacaggccgataaataaactcaggctcggcagctgcaccgtatcatagtaagtcccggcttttgaagcaaaatcagaatgcacgtcgatataattgccgtaaatctcattttgcaaggattggctgatctcaagactgtctttccaatgatcatagctgtagccgtataatgacgcttgatcaccgagtgatttcagctgatcaaaggtttgatcattcaccgcgatgatagcattcaatgagatcagcggttttttgacttcttttaccgacagtttttgatcagacagctcccctttttggttcagcagcttcagctgatccggcgcttcgtttttgaaattgcggtcatacgttcccgggaaatagacagcctcgtcttctttcaggccgttcactttgacatggaagtattttgccgcatccgattcactgatcatgtaaacagggggaacagtttctccttcctgatagcgaacataggaaacatctattttgtctttcttatacgtaaagccgtgtgttttcagttcatggtcaatatctttcaaatgagtctgttcttttggattgttgctgtaagataaatactccatttcataagcggactcttccgctccgacggtcgatttgtacattgcgagcacgcctgtcgcagtaaacgcaaccgcggaaataatgctgacaataaagaacaggcgggcgttgtcttttagacgatagacaaggtcagaaacccaaatgatgtttttcccgcgcagataaaaggttttccacttcttcagcgcgcgcagaatccatatgctgctttggctgaaaaagaaatatgttccgataacggtgagcagtaaaatgataaacggttcggccccgtggacattgcctttaagaaccatgccgtacccgccgcacagacaggcgatgccgaataaggacagaagcacggacggcttaggctccggtttaaccttgccagtgccctttattaatttgataaccgtatttgatctgacaaaaaggatcgtaaactgcgataaaaagaaaaataagagcagaaatccgcaggccgtaataccgagcgctttccaaggcatatacaaaggcagcgcgtccatttctaaaatataagcgccgaccgtaaagaacgtctttgaaaaaatgaatccaccgattatgccggctgcaattgacatgacgccgatgatcatattttccgcagtaatgagctttctcagctgccccggcgtgatgccctgcatgagcagaatgccgaattctttatttctcgatttcaaaaatgcattaaccgaatacagaacaaataagaaagaaaaaacaaagatcatccattccgcggcggttaagccttttttggcgatgttattcaggtagccttcctttaatgccggatgaaacaggaacatcgcaaaggtaaagaaaatcaaaacggaaaaggcgctgcttaaaaagaatgcaagataagcccttttgtttctcgtgacgtttttataagcgaactgaagaaaggtcatttgcgtttccccccagcatagacagcacatcaagaatttgttcataaaagacttggcggttttccccgcggtaaatctcattaaacaattcgccgtcttttataaagatgacgcggcggcagtagcttgccgaaaccggatcgtgggtcaccatcaaagccgtgacatgatcatcccgattcaggctctgcaacgtttccatgacgtcttttgtcgctttggaatcaaggtttccagttggttcatcggccagaatgagtgacggcttatgaatgaccgctcttgcgatggcggcccgctggcgctggcctccggatacttcaaacgtccgcttgttaagcaggttttcgataccgagctttgccgcgatgccgtgcagtttttcttccatgacagacggcgcttctttttcaagcgttaacggcagcatgatattttcaccgatcgtcagcgtgtctagaaggttgaaatcctgaaacacaaatccgagctgcttgcggcggaaatgagcgagctttgtccgcttcaggcgatgcgggttttctccgttaatcaggatatcgcctgaatctggacggtcaatcgttgaaatgatattcaaaagcgttgtttttccggacccggacggccccatcaccgccgtgaactcgccttcttctattgaaaatgaaatttgctttaaggcctgataggacacttgtcctttataggttttatttatatgtttgacttcaagcatattcgccatgaaaatcctccttatggttttattcttgttgatctgggctgctttcatgtagtgccgggacgttcaacataaaaatccccttgacataaatccatgttatcaaggggaaacaaagcgggctatgttgttttcttaacgcagccttacatttttgtaagaaatgaaaatcgaactgatgtcccttcaccgggagacgagctgatgtccaccgtatgattgagcttatctgtaatttctttgacgagatggaggccgattcccgtagattcttggaaacgccgcccgttttcacccgtgtaataagggtcaaacacccgcttgatgtcttgtgagggaatcccgacaccgtaatctttgacttcaagcaccgtcctgtcttcatcgcggaagacattcagctcaagtctgtcactcttgcccgctgaatacttgaccgcatttgtgaccacttggccgatcgcaaatttgagccatttggcatcggtgtaaatctgatgatcatcgcaaacgttcattttcggataaacgcgatattgaataaaaaatcgtttatagctttgaatgactgattggagaagctcggacagggaaaccgcttcgattttaaaatcccgttcaaacaggtcgagccttgaagaataaagaagcgtctccagcccgaattcaatctgccggacttcttttttgatttgttcaaaaacgggctcatcctcttcttgaatgattaaattaatgaccgacagcggcgtcttcacttggtgcacccattgattcatatacgtcacccgcgcgtcaagcttggcttcggtctcatggagcttctggtgctgcagccggatcagctccatctgcttttcatacagctctgaacagaacactgaagaaccgagatacgggatatccgtcccttcctgccccgagctgagccaatgatacacgccgcggtctttgtaccagcgataggcaagatagcccgccaaaataagaagctgcacgcccaatatgtaaaacaagtgagaaaaagaatgcagacccgcaaaccagtaataaaagaagacaaacagcccttgaaggagaaaaagcagaatcagcactgcatgagaccggagaaacagcttcatgactgcgccctcagctggtagccttcgccccgcaccgcttcaatagaaacaggcgcattcagctcccgcagtttttttctgagccgcgtgatatacacgttaagtgtattatcatcgatgaatatgtcggtgtcccacgtcttttccatgagacggtcccgactcgtcaccttttctccccgctcaagcagcacttccaaaagcttgctttcttttttagaaagctcgcttttttcatcctgaaaacgcagttcaaaccgttccacaaagagctgaacgccggcatattcaaccactttctctccctgctttgcggcgtactccccgtacgccctccggatctggcttttgattttcgcaagcacaatatcataagaaaacggtttttcgatataatcgtctcccccattttcaatcgccatcacctgatccatttccccgcttctggcagaaataaagatgatcgggcttgtggagtgctggcggatctgccggcaccaataatatccgtcatatgccggcaaattgatatcaagcagcaccacatcgggcttttcccgcaaaaagacatcaagaacagctgtaaaatccgcggcgaccactgtttgatatccgtatttttcaaggtaattctgcaatagtccgcgaatgtcttcactgtcttccacaatcataattttattcaaactgaaccactcccgtttcttacactgctgccatcatcataatcgttttgggcgtatggacgcaacaccgcacaaaaaaaccgccatctcggcggtttctgatctctttagccgacctgctgcttagctgctttaccggctgatccgaactctctcattttgcttcgcactgtctcttccacggcttcaatgccgggtgtcaaatagccgcgcggttcgtacagatcgctgttttcctgaaacatgcggcgtgtttcgtctgtccacgctaccatacattccgtattgatattgatcttcgcgtggccgagtgtgatggcttttttgatctgatcctgcggaatcccggatgccccatgaagaacgaggggaatatcagtcatgcgagagatagcctccatttccttaaatccgagattcggctcaccctgatatttgccgtgtacagagccgagggcggcggccagcgcgtcgatattggtttctttgacgatccgctcacattccgcgatatcggcatagcggaccccgccgaccaggccgtcttccattccaccgaccgtgccgacttcggcttctactgacacgccgtgttttgcggcataatcggtgacttcttttgtcatcgcgatattctcgtcaatcggctgatgggagccgtcaatcatcactgagctgaatccggcatcaatggcctgtctacagcgttccgcactgctgccgtgatcgagatgaagcacgaccggaacggtaatcgccatgtcctccattaacgcgccgaccatggcggcaatcgttttaaatccgcctaaatagtcgaccaggcgatcggaagccgcggcgatgaccggtgattgctccttttgcgccgcctgcaaaatcgccttcgtccactgcaggccgttgatattaaactggccgatcgcatactgctcccgctttgcatcttcaagaagctctttcatcgatacaaaagccatgtccacccctcctttatccattacatgttgaagtattttgatacgacgtccactgttgtttttttcgctgtttgaatggcttcctcagcagtcagcttatagtattcaggccggaatagctcaaccgatacaacatcagagaagccgatttccttcagtgctgataagtgggcatctaagtcaattgccccttgtcccggccatacacgatcctcatctgttaaaaagccgattgggaaatcttctgtatcatcgatatgatagatgaagattttctttccgtccgcctgctttaagctctcaatatttgaacccattgcatggaagtgaaaactatcaaggacaagcccgacattgtcacggttaactgtgtttacgatctcatacgcctgttcaaacgtattgaccgtacattgcggatggccgacaaattcaagcgcgatttttacgccgtacggctccgcgatatctgacagctcagtcagcacctctacactgctctttttgatctcttcttttacaatcttctgctctgtcacaagcggaacggccaccacatatttcacaccgagggttttgcatgtttccatcatgcctttaaattcagtgatgatctcgttgtggcccttttcatcacggttgttgaagaaaacaagcgcgtttagggcaagcggtttgatgtgatgggtttgaaaatattccgcaagatctgccaatgaatgatcttttaagtactcgggcagcttatccattgtgcggatttcaatataatcatagccgtgcttttcgcatagttctaaatcctgtttaaggtttgagttttccaatgttgtcgcttcattaaaacaaagtttcatgccagactcccccatctgcgttttagatatgaagggagttcggcaggaaggctgtcgccatatcccgccgaactccatgctcagcttatgccagacctaattcttctttcattttcttaagcataaatcggcttgattcatccgctctttcatcgacccaagcaaatacggcattcgtcgcaattccgtcgaacttcatctctctcagttttctgaaaatcgtatcaaaatcaacctcgccttggccaatgtccaaatgctggtgaaccgttactttcgcgtcaggcggattgacgatgtagcgaaggccatgagccgctttatgattataggtatctgcaaataaaacatgtgtgaggcggtcgccggcttcgtcaaacatggtctcgatgtcgcctttgccgtcatcatagaagaacgtatgcgcagtcgagtagacaagattgatccaatccttgtcaagcgcgcggatcatatccatcgcacctttgtgcgtttcgataaaatcgtatgggtgggcttgaagattaagtttaataccttctttttcaaagactggcagaagctcatccatggatttgataaatttttcttcacttgttaaaggatcatattttgaaccgctgaattcgctgttcatcaaatccacttcaagttcaaccgcaatttcgattgcccgtttccaattgcgcaccgctgcctgccggcggtcttcatcaggacccgcccagtggtaaagaggaagaagcgatgaaagcttaacacctgtatctcttaaaaggcgctttaattgtttgatctttgctgaatcaactttcggatatttataaaacggacaaaaatcctcacgcggagacaattcgatatattcatagccaagctccgccgttttatagaccgtttcctctaaagttaaatcatcacgatacatggatggatccaatgctaacttcatattttcactcctctgttttttagttttgaactgttgtaaaagattgatagaattccggtttttccttcaattcaaccttttctttttgtccagattcctgggcttttacacacgcgtcagtcgtgacagcagcaatatagccgtcccatgccgtcggtccgctgacctcgcctttcttttgaatcgaatcaataaagtcttggatttccacatcatacgcagcgacaaagcgtctctgccaatccatcaaaatatcagtactgaatctgccttcttttctcaagctgatgcttgatggctcgggaagcttgatgatgccgtcttctccgacgatttcgcattgaatgtcatagccgtatttacagttcacatagatttcagcattgatgacgataccgccttttgtttcaattacgacgatttgcggatcttttaaatgcggcagcgcgtttttcgattttttcgggtagatgacttgaacggactcgtagtcatcgttgacgagccagtgcagcacatcaatttcatgaacaagcgtgtcgactacggccatatcggttgtgtagttatctcctacagtcgggttgcggtgcgcgcagtgaatcataagcggttcgccaatcacatggttatcgagtgcttccttcagctgtacgtaaccgctatcataacggcgcatgaagccgacttgaacaaggcgtttgcccactttgatttcttcttcgacgattcgcatgcatccttcagccgttgtcgcgagcggtttttcacagaacacatatttctgggctttaatggctttcagcacgcttgactcatgcgcaggcccccagcttgtcactaaaacagcgtctacattttcgtctgcaagcaagctgtcatcattcggataaaccgtcgcgtttaattggtattgctcaacgaccttttgtgcagcttcttgattaacatccgttacagctacaatttccgcgccggacagcttgttcgtgatgcggttaatatgttcttttccgattgctccagttccaattacgccaatacgtaaactcattgacagccactccttctgttgattacataattttgctttctgtttcttgctttacttggctctgaggagatccgtagagttcctcttgaatttgttcaagcgacttgccagacgtattcggcgcaaagagcagcccgatgatcatactggccgtcacacatccgagaagaattgcagccatcgttccaatgccgaaattggtgataatcattgggacaaacagactccaaatccctattgaaatacggacaaggaaaaacatcagcccttgtgcggaagcacgatattgcgtaggaaagatttcactggcccataactgatagttcgcttgctgccctgctccgttattgatgccgatcacgacaataaacaggagcagaatcggcaggccttcaattggcagcagaaacagtgtccacccgatcaccgccatgaaagcggcgattccaaatacggtttttctatatttgtcggcaaagggcatgaagatcaaggcgacccccaatcctgtgaagataaacagccccatttgcaaaaggttggccatgttggcagatacaccgccgacctgctgataaatgtatggcataaagaagcccatgaccccggcagctaagttccaaaccaagtacacacccatcaaaaacaatatgctttttagatacataggcttgagcaaatcaaaatacgatgtcttattcagtacagccggcttctctgcctgagcatcctccggctgattttttgtctgccaggcgtctgattccggaagcctgattctcaggatgtacgtaatcagcgcaatcacaagcagatgggcaaatacgattttattccccaagagtcccaagtcaccggccagtacggagagaagcagtacaacgacagcgcccgcggcccaagcgacttgtgctacgccgcaatgcctggcccgattcttctttggcgcattttccgcaataatggtccatgacgcggttatatcagctcctactgataaaccgataatgatgtaaccgcttaacaacatggggaaattaaccccgaacaaaaccaaacaaatccctagtgcataaaccagcatactattggtataaacagccttccgtccgactttatcagccagaaacccgccaagcagcgcgccgacagcggcagaaatcgcattcgcgctcagcgcgccgagcagcccgatttgcgtatcggatagcttaaggtaactgacccataatgataaaccggcggagcctgccacaattgaaccggcatcaatatagttggccaatgctgccgcgattgtccgtttattgaaggctgaatctccattggtattgcccatatgttcattccccattaagccagatccaacaactgctgatcaatatagtttctcgcaatcaatgcatactccagcgggtttgcaacatcggggtcctgttcagcttcaatgacaatccatccggaataactgtgcttcaacagcagctgatatacttctctaaagtcaatgcagccgtcaccgggaaccgtaaacatgccttttaaaaatgattgccggaacgattgtccttcgagcctgcattgttccatgacattcaggcgggcatccttaaagtgcacatgcttaatgcggccgatatgcttctcaagcatccccatgtaatcgccgtcagaaatatacgcatggcctgtatcatagaggaggtgtacatgcgcagggtctgttcctgccatcaggcggtccacttcttccgctgtttggacaccagtgccgagatgatgatgatagacaagcttcaagccatgctgagcggcaatttcgccaaggtgattcagcccttcgcaaagccgctcccattcatcatccgtaaagtgcggcttctctgtgaacacatttttctccaagccttgcacgctgtacgtttgttcagagacaactgcgacatccgcgtttacttgctgcaaatactcacaatgcagggtaaatgtctttgccgcttcaccaagtccgtcacgcaaaataaaactgctgaaccattttcctgcaatgcgtaagttccgaagcttcagctctttgttcaggacggcaggttcggggaaaaagcccccgacttccgtgccttgaaaacgtgcgacaacgatatcacttaacaaatgctgaagtgtatttcccgctccaatttcaggcatgtcatcattccgccacccaatgggagcgattccccacaggatttcatttttgcccatcttggtgcctcccctctaatactgcttcgcagattccagctttttctcttttgcttcgtatgccttctgaacgctttcttgttcagatacctctgccaccccgacatgccaccagctgtcatagccgtccgtcattgttttaggcagaaccttcatttcaattaatgttgatacatcctgtttcttcgcatcctctaacgccgcttttaattcttctactgtgtttgcacggtaggttttcgcgccgtatccctcagcgactttcgcgtaatcgacattcaggatttggttgtcatctgtgcggaactcgcaatagtagctgccgctgccgtgatccatttgcaggttgttgatgcatccgaatcctgagttgtcaaagagcagcacattgattttcttgttgtattgaatcgccgtgatcaattcagaatgaagcatcaggaagctgccgtctccgacgattgaatacacttctctgtcagggtgggccagtttaagaccgagtgtcccggacacttcatagcccatgcaagaatacccatactccaggtgatacgtattcggaacattagaatgccacagacgctgcaaatctcctgggagtgagcccgctgaacagatgatgacgctgtcttcaggaatcgtctcgttgattgtcagcaatgccgttgtttgcggaagctccgtattcaacgcgtcagcatattcattcaggacctcttgagaaaaatgatttttgatttccggatcaaatgcttcccgcttaaacgtcactttgctgagacgctcgcgttcagctagccattcgtccttcagctcccgaatcgttgtgccgaactcgctctcatagccttcaagcaagccatgcagtttgccaagcgtcgctttcgcatccgctaccacttggaatgcatcaagtttatacgcctgcattcggctgacgttaatgttcaaaaacttcgctttatcaaaatcaaaagcggtcttagaggatgtcgcaaaatctgtataccttgtgccgatgccgataatcaaatcagcttggcgggccgctttgtttgccgcaagtgtacctgtgatgcccattccgccaaggttgttcgcaaaatctgcctcaacagtagactttcctgcctgcgtttcaactaacggaatgttataggcttcagaaatggcaaccaattcatcgcgcgcaccggaatattttgcgcctccgccgacgagaatcacaggttttttgctggatttaatcagctccgccgcaccttgaagctcgcgctcgctcggctgcatgcgatcaatatagtgaacccgtttgacgaagaaactttcatcaaaatcgtatgcttccccttcaacatcctgagaaatacaaatcgttgccggacctgcttttgccggatcagtcatgacttcaaacgcgcgcagcaaactgctcatcagctgctcagggcgcgtaatgcggtcccagtatctcgatacaggcttcaatgcatcgtttgtcgtaatcgccgcactgtattcttgctccatttgctgcagtacagggtctggctgtcttgtcgcaaatgtgtctgccggaatcaagagaactgggatattgtttgccaatgcagtgccggctgccgccaccaagttagccgctccaggtccgacggatgtagacaccgcatatatttttcttctcagcatttgcttgctgtacgccatggccgcatgcgccattccttgttcatttttcccttgatagactttcaaatggcctgcatcctgctcaagcgcctgcccgatccctaatacgtttccatgaccgaaaatcgtgaagatcccttcgacaaaaggctcttcctttccatctacatggatgtactgctggtttaagaatttaatcagcgcctgtgctgttgttaagcgaattttcttgcccacaaacgatcccacctttactcgatctttttcaattatgactgtgcttcaataagctgtacgatttcatcagcagtcggcatcgcttctgacgaactgtgcttgctcaccacaatggaagctgaagcactgccgtatttcaatgccgtttcgatgtcttttccggtgacaaggccatagataaaggctgacgcataggagtcaccggctccaaaagttttcagcacttttgtcttgtacgcttgagcgcggaatacctcgccggatttgctgtatgcgtaagagccttcgacgccgtgtttgatgacaacgaggtcggctgaatggccaaataaatgattgacggattcttcattgcttccgcctgtgcggttttccatcacatcaaattcatcgcgtgtgccgatgacgatatcagactgctcggcaaccaaagaataataaacggctgtttcatctgatgactgccacgtatacgggcggtaatccagttcgaacaccactttaacctgatgcttcttcgcgtattgaacagcttttaataccgcttcccgtgacgggcttttggcgagcgctgtcccggaaacaagcagcattttcgcatttgcgatatagtcttcgcttacctctgaaggctcaagataaagatccgccacatcatcgcgatacattaaaatgctgcattcttcagggctgaggatttctgtaaatgcaaggcctgctttgtgtccatcttgatcaacaaccatctgtgttgtatcaacgccggtctttctcatataggactctatgaatcttccatgctggtcatccggaattttgccgatgaagcccgcttttaagccaagcttcgcgctgccgatcgcgatattcgcaggtgaaccgccgacatatttcgaaaatgtcatcgtttcttccattgggcggttgtattcgactgcgttcagatcaatacatgcccggccgatggcaacaatatcaaaagccttctcttcattgaatgtatacttcatcgtaaacagccactcctcacttgttagcgttctaaaatccattcatgcgccgggtcgttataaaacttccattttcgcgtcggccctgccatgacatttaaatagtaggatgtgtatccgtccggaacgcctaccgggtggtatcccgcaggaacgatgacaacgttttcatttcccacagtcattgtctcgtcaatagaacggtcatctgtgtatacgcgctgaaacacaaagccctgtcccgggtctaactcatggtagtacgtttcttctaagaaagattcttccggcaagttgtcttgatcatgtttgtgaggcgggtagctggaccagttgccgctgtctgtatagacttcaactactaatagactgttagctgaagggtctgaatccggaagaatgttatgaacagtacgtttgtttgaaaattgcccgcgatgctcaattccgttgtcttccgctttgatcagctttgtcggaagctgcttttccgatggagaatagcaaagcgccactcttgcgtcgctgactgctgtgatctcaaatgcacggtcatttgatatatagacgctgtctgtcggttttcgttcaaatacgctttcacgcgtgccgatattctcaaaagtcgactcatgatctgtcactgtaatttttcccgttaccgccacaatacagatttcttgttttttcaattcttctgtatagcttgaacctgatgcaagatctaacactttaaactctacataagtgagatcagagttggatgtcgttacttcgtgcacgagtttgaccccattagacacttcatgcgactgcggcttacgcaacaaataactcatagagaagccctcctctttctattggcagaatgagtccgaacagcgcacatggacgccgttcggctgttcgtcgtttagttgaaatcaggtgccggatatcttgccgtcaccacttttttacgtgtatagaagtcgacgctgtcttttccgttcgcatgcagcgttccaaagaatgaagatttccagcctgagaatgggaagaacgccattggagccggcacaccaaggttgatgcctagcattcccgcatcaatgttttcacggaagtagcggattgcgtttgagttggatgtgaacaagcaggcgccgttcgcaaactcagacttattggcgatttcaatcgcttctttcaggtttttcacacggatgacagataagaccggagcgaaaatttcatctttccagatcgtcatttctgttgtgacattgtcaaagatcgtcgggccgacaaagtagccgtcgtcagacacattttcacgtccgtcacatacgagtctggcaccttcttcaagacctttttcgatatagctgagcgtgcgcttcttgttgtcttcgcgaatcaccggtcctaagaacacgccgtcatcaaggccgttaccgattttaatgtccgccactttttcctgcagcttcgccataaattcatcggcgattccttcttcaactgtcacaaccgcacaagccatgcagcgttcaccggcagaaccgaaggcagctccaacgatgtttgtaaccgtgtcttcaagattcgcatcgttcaagacaatcgtatggtttttcgcgccagtcagagattgaacgcgttttaagttttcgcttccttttttgtagacgtattcgcctactggcttggagcctacaaatgaaatcgctttaatttcgggatgctcgaggatgccgttcacaacgtcatgcgcaccgtatacgacgttgaacacccctttcggaaggcccgctttttcaaaaagctcaaccaatttctctgttaacagcggagtccgctcagatggctttaaaataaatgtgttgccgagcgcgatcgccatcgggaacatccagcaaggaaccatcatcgggaagttgaatggcgcgattccgccgacaactccgattgggtaacggtagttcgccgcttcaacgtccgttgcgatggaagcaagtgagtcacccatcatcagggaaggtgctccagcggcgaactctacgttttcaatcccgcgtcccacttcacctaaagcttctttcgtgttttttccgttttcaatggtaattagatgagcaagttcttctttatgctgagacagcagctgctggaagttaaatagaattctggcgcggcgaggaaccgccacctttgaccatgttttaaatgcttcagccgctgtttgcgctgcgtaatcaatatcctcttttgtagaaatcggcacttggcatagcacttctttcgtcgccggattgacgacatcttcatattgatctgttttgctttcaacccattcaccgttgatgtagttttttaattttctgatttctgccattcttattgcctccttcattagtaaacacatacacttgtatggatggttccggatagattcatatcaatatccacttttcagcaagccaagaattaaacgctttcaaaaacaccaaaaaaataaatggcggatgcatatttacatacaagcaaccatttcatgcacaacaggttactttttggtcatttcttggttatattctaatcgcataatacccataagtcaatcataaacactacattttttcattatttttattatattaatcttttaatcaagtaagagaagtaagagaaggccgtccaatcttgcaaaagatatacaccgatgttatcattttttaagcaactattgattaacttttggtttttattatatatttatgttacgtaaagattcaagaaggagttttttatatgaaactgatgcggattcaggaaatggaggagtacattttatcgcatggcactgtttccttagatgagctgtgccaggtgttcaatgtctccaaaaacacagtcagacgtgatatcaacaagctaacagaaaagggtgcgattgaaaaagtatacggcggcgtaacatctattgaaaaaaccgcattagttccttttgaaaatcgcaccattcagcaccaggatgaaaaaacaaaaatcgcccattatgcttcccgatttattgaagatcacgatttggtcttcattgattcaggaacgacgacaaagtctattcttgatacgcttgatccagccaaaaatgtcaccatcttaaccaacagtttagacattatcaatgcggcgtcagctttgaagaatatcaacttaatcattatcggaaacaactataagagaaaaacccgctcctttgtcggcatggacgacccggctatgcttgataagtacaatatcaacaaagcctttatgtccgctaccggaacgacgctgactcacggattgaccaattcggatctgctggagtatgaaattaaaaagaggatttcagaaaaagcaaaagaagtgtatctattggctgaccattctaaattcggaaaatcaacgcttctgacgtatgcaccgtttgacaggctgcattgcattgtgacctctcagccattagacgacgagtacacgcagtactgcaatgagcatcaaatcggcattcatctggcctaacgtttacaatagtgttgagagtctatcatccattttattctaggaggcagatcatgaaaaaagcgaagctcggaaaatcagacttgcaggtattccctatcggattaggaacaaatgctgtcggaggacataacctctacccgaacctaaatgaagaaaccggaaaagaattggtgcgcgaggcgatccgtaatggcgtgacaatgttagacaccgcttatatttacgggatcggccgttccgaagaattaattggtgaagtgctgcgtgaattcaaccgtgaagatgttgtcatcgctacaaaagccgctcacagaaaacaaggcaatgactttgtctttgataattcaccagaatttcttaaaaaatcagttgatgaaagcctgaagcgcttgaataccgattatatcgatttgttctacattcacttccctgacgaacatacgcctaaggatgaagccgttaacgcgctgaatgagatgaagaaagccggaaaaatccgctccatcggtgtatccaacttctctttagagcaattgaaagaagcaaacaaagacggtttggtagatgtattgcaaggcgaatacaacctgttaaaccgtgaagcggaaaaaacattcttcccgtatacgaaggagcataatatttcatttatcccttacttcccgctcgtatcaggtttattggcaggaaagtatacagaagatacaacgttcccagaaggcgacctgcgaaacgaacaggaacacttcaagggcgagcgtttcaaagaaaatatcagaaaggtcaacaagcttgcgccgattgccgaaaaacacaacgtggatatccctcacatcgtattggcctggtatttagcaagaccggaaattgatattttaatcccgggagcaaaacgtgccgatcagctgattgataacatcaaaacagccgacgtgacgctttctcaagaggatatttcatttattgataagctgttcgcataagaagaaaacagccttctccattggagaaggctgtttttttgtgcgataaattcctaaataactgattttgaagcaaaaccttacaaaatgagccataaatccgataaaataaaggtagtttatctcagaaagaaagtgattgagaaagcaaaagtatgaaacgttcatatcatctagctcatatgaaataaagctgacccagcttcttttatttgctggtcagaatagcggaccatttcgatggtctatggaggaaacagaatgaaacttaaatatgtaaaagccttagttgcagtaaccgttgctttaggtgtactgctgccatcaacgatttctcatgcaaagagctttagcggccgctcatcatctagttacagcagccgaagttcaagctcgtcatacagcggaagctataaatcaagcccgaaatcaagctacagctcaggatcaagctcttctagcaaaaaatccaagacgcctgacgattcatcatcatcgatttcgcttaaaaagaagccttcggaaaaggcaagctcatcaagctctaaaaaatcgtcaggcaccttttccggcgctacatcaaaagtaaccggaaagacatacagcggaaaaacgtctaaagcctatgttggcggacgatatgtttcagtcaatcattactatcacgcaggtttcgcgccatcaggatggtttggatattatagcggatttacaatgggtatgttcatgatcagcatgatgcacccatggggttacacctatcatccagtcggaggcccaggttatgtttcttatggcgcttcacccattgcctggatcgttgatatcatcgctttgattattattttaatcattgtcatcgcactgattcgcgcatttaaagcaccgaagacgtacagaaggagattttaggcaatgagattaatattaaatgagcaagaaattgtagacggaatttgcgtgtatatttccaatgaagaagatatctaccctgaagacgttgaagtaaaggagctatcttataacaagcgtacagggttcttcgctgaagctacatttggcctgcaccacaagcagcttatgtcagatgacatttcagaaggcattattcagttcttagaggaataccacaacttcaatccggacgttaccgtcgttgaattgcaatttgataagaaaaaaggcttctccgccttggttttcgtcaacgaagcagaagaataaaaatgtcttaatcaaaaccttactccgcgcgggtaaggtttttttaatggtttctctgagcataaagttatttcgtttttcctaaactcagcggatctgtgatcatctcttttggctttaacgtttccgtttgttcaaaacaaatgtttcaaatgagataggaaatgggtactaatctattaactttgttatacattttagatactcattggctcaacaactgaggaggagacatttgtgaagaaagacacaaggaaatatatgatctactttttcggcgctttagggggactgctatatggttacgatacaggtgttatctccggagcactcctgtttatcaataacgatattcctttaacgacattgacagaaggattggttgtcagcatgctgctccttggcgcgattttcggttcggccttgagcggcacatgctcagaccgctggggcaggagaaaggttgtatttgtcctttccatcatttttattatcggtgcgctcgcttgcgcattttctcaaacaatcggcatgctgattgcatctagggtgatactcgggttggccgtcggcggttcaacggcacttgtgcccgtgtatctttccgaaatggcaccgacgaaaattcgcgggacactcggcacaatgaacaacttaatgattgtcaccgggattttgctcgcctatatcgttaactacctgttcacaccgtttgaagcgtggcgctggatggtcggtctggctgcagtgcctgccgtgcttctattaatcggcatcgcgttcatgccggaatcgccaagatggctcgtgaagcgcggccgtgaagaagaagcgagacgcatcatgaacatcactcatgatcccaaagacatcgaaatggaattggcagagatgaagcaaggggaagcggagaaaaaagaaacgacactcggcgtgctgaaagccaagtggattcgccctatgcttctgattggcgtcggtcttgccattttccagcaggcggtcggcattaacacggtcatctactacgcgccaaccatttttacgaaggccggtcttggcacatcagcttcggcgctcggcacaatgggaatcggcatcctcaacgtcatcatgtgtatcactgccatgatcttaattgaccgtgtcggccgcaaaaaacttctgatctggggaagtgtcggcatcacactgagccttgctgctttatcaggcgtgctcctaacgctcggactttccgcatcaacagcgtggatgacagtagtctttctaggtgtctatatcgtcttttaccaggcgacatggggtccggtagtgtgggtgctcatgcctgagctcttcccgtccaaagcacgcggagccgcgacagggttcacgactttggtgttatcggcggctaacctgatcgtgtcgcttgtctttccgctgatgctaagcgcgatgggcatcgcatgggtctttatggttttctcagtcatttgtcttctctcatttttcttcgcgttctacatggtgccggaaaccaaagggaaaagcttggaagaaattgaagcaagcctgaaaaaacggtttaaaaagaagaaaagcacccaaaaccaagtgctgaatgagcgtacattataaaaaaaggaatcgtctccttatgggacgattcctttttctgtttacaccatgaccttgcaaatattgttcgtaaattccacagggtcctgaatcggcaggccttcgatgagaagcgcctgattgtacagaaggtttgtgtacaggctcagcttctctttatcttgttcaaacgcgtcctgcagcgtttggaatacctcgtgatttgggttgatttccagcactttttccgccttcacattttggctgtcaggcatcgcgtttaagattttttccatctcaattgtcacttcgccgtcagcagcaaggcagactggatgtgatttaagccgttttgagattctgacgtttttcactttgtctgacagaatgtttttcatttcctcaaacagatccttatacttgctttcctcttcctcggactgcttttgatcctcatccgtgtctatgccaaggtctccgcttgatacggacttgaattctttttcctgataagaagccagcattttaattgcaaactcatcgatgtcctcagtaaagtagaggatttcatagcctttgtccgccaccatttccgtttgcggcagtttctcaatgcggtcgtaagaatcaccggtcgcgtaataaatgaatttctgctcctctggcattctggaaacatactcgtctaagctgaccagttttttctcttttgaagagtagaataataggagatccttcaattgatccttattcgcgccaaaatcattgtacacgccgaatttcagctgtctgccgaacgacttgtagaacgtctcgtatttctcgcggtcttttttcaacaggctttgcagctcgcttttgattttcttgctgatgtttttcgcgatcagcttcagctggcggtcatgctgcagcatttctctggaaatattcagcgatagatcctcagaatcgaccatgcccttcacaaagctgaagtggtccggtagcaggtctgcgcacttattcatgatcagcacgccattggaatacagctccaagcctttctcatattccttggaatagtagtcaaacggcatgttttcagggacgaatagaatcgcgttgtagcgaacggctccatccacactgatatgaacgtgtgtcagcggtttatcaaacccgtaatgcttttcagcatagaatttttcgtaatcctcatctgtcagctcgcttttgttttttctccagatcggcaccatgctgttgaccgtctgctcttcctgcacctcttcaaattcattttcgctgccttccttcggcttattaatggttgtatccattttgatcgggtagcgaatgaagtcggagtacttcttgatgatcgcttttaaacgatattcctctaaaaactcgtcatagctgtcatcttctgtgttctctttgattttcaggataatgtctgtaccgacagaatccttttcacacggctcaatcgtatagccgtctgcacccgcagactcccatttataagcctcttcgctgccaagcgctttactgatgactgtcacgacatcggcaaccataaatgccgcgtaaaaaccgacaccgaactgcccgataatgtcatgtccgtctttcagctcgttttcctttttaaacgcgagggaaccgctttttgcaattgttccaagatgctgttcaagctcatcctttgtcattccgatccccgtatcagagatggttaatgttctcgcatctttgtcagctgcgacctttatgtagtaactgtctttatcaaacgtaagcgcatcgtccgtaagcgctttgtaatagattttgtcaatcgcatcactcgaattggagattaactcgcgcaggaaaatttctttttgggtataaatggagttaatcatcatatccagcaagcgtttagactctgctttaaactcttttttcgccactcttgatcgctcctttaccattatgtaaacccttttcagcatctatttatcacataagatgacaattgtcaatcaggttgatagatgcatatatatgtaaatttaacattagttggatttgttttcactctttttctcactcattctcataaaaaagagaggcttcatcatcctctctttttttctgtgtcattccagcggccaaactcccgcttcatccatatatgcaccgggtagaaaaacaaaccgaacggtatcaaaaacaatagattatgccatgaagcattcagaaatgcgcttgcagtcactggaaacgtaatctcttgcaataaaaaagagatgacagtcagcacaacaaatgcagatggaatggtcacgatgcaataaaacttgagctccttcttatgctgtaccttcaaacttagaaacctcccaacaatttctaattcatcttaacatatgctggcctttcttttctcgcatgtttatcactgcacatagcgggaagacaaatagaaaaaggaggtctcgtatcatgggaagacttgaaaacaaaacagcagtgatcacaggcgccgcgacaggcattgggcaagcgacggcagaggtttttgccaatgaaggcgcgcgtgtgatcatcggagatatcaataaagatcaaatggaagaaacagttgacgcaatcagaaaaaacggaggacaggccgaatcctttcacctcgatgtgtcagatgaaaacagtgtgaaagcatttgctgatcaaatcaaggatgcatgcggaacgattgatattctgtttaataatgccggcgttgatcaggaaggcggaaaggtggacgaatatccggttgacctgtttgaccgcattatcgccgtcgacctgcgcggcacattcctttgcagcaaatatttgattccgctcatgctcgaaaatggaggctccatcatcaacacctcctccatgtcaggccgtgccgcggaccttgaccgctccggctacaacgcagcaaaaggcggcatcaccaacctgacaaaagcgatggcgatcgactacgcacggaacggcatccgcgtcaattccatttcaccgggtacgatcgaaaccccgctgattgacaaattagcaggcaccaaagaacaggaaatgggcgagaaattccgcgaagccaacaaatgggtcacgccgctcggccgcctcggccagccgaaggaaatggcgacagtggccctgttcctcgcgtcagacgacagctcatacgtcacaggagaggacatcaccgcagacggcggcatcatggcatacacatggccagggaaaatgctgattgatgagaaatggaagaaagaaacgaaataagagaggggatgtccctctctttttgtctttcaaagcaatacaaccttatactttttcacatccaaaaactgcaaaaattccctcgccagcacttcaggcggatgcgcctttccttcatccagccgatacaaaagcaacccgataatcattgcggatacataatgggcataaagctttttctctgcgtgaatatcagtttgctgatgcagataaaacgattccagcgctttgaacatatcaggtatcacatgaggaacaccccattcccgattgagaaaatggacaatgggcatatttgacaaagcagaaagcagactggcgagcgccttctccgcttcctttaaggaaaattcattcgggctggaggcaatcgtcaggtgatcaatgatctccgcacatgatcgctgtatcatggttcggagcaattcctccttattggcatagtgatcataaaaggttgcacggcggatattgcttttccgggtaatatccgaaattgtgatggctgcgtagtcttttttctccgccagcacgtccagaaatgccttctggagcgcctctctcgttcgaaccacacgcctgtcgatttgcttgtccttctctcgctctcctggcacagcttgtccaaacagccaataaaatctcttttgagaaacaagctcccataccttttggctgatagcttccggagtcgcggccgcatcctcattcagccaatacaggataatcgcgtacgtgtacaaggcccggtaatgtccgtaaatttcccgttcgatcggcgtcaaattcacatggaccggagtcagcagcacatcctgctgaaacacatccttaaaaaaacgatggaaatgccctctgttcatcatcacagaaaaaaaggatcgatgctcatgaacaaaggacagcgtcggatgcaccgtttgccgttttttgttcaaatggagggtatccatatgactgaaggcgccaaaaagcgctttgcccagcccttccttcttgtcttcgattaaatcctcaatgattgaaaacttatcctcataataaaggtagagcgatccgcggctcactttggccttttcagcgatttctttcattgtgatgtgttgaatatctctttcttccaataaagccagcagcgcctctttcacttgagcttcggcagattccggcacaaaagacacccccaatcattagacagatcttcgatatatgtacggtaacgtatagatggttcaccgttgtctttcttacagaaaaggtaccaccttataataggtccgagaaaagaagaaagcaaatgagggggattttacaatggaacagcaagtaaaggacgacatccagcgtgtctttcagcttcagaaaaaacagcaaaaagccttgcgcgcttcaacagcggaacagcggagagaaaagcttcaacgctttttagattccgtcatcgcccatgaagaagaaatcatcgaagcgatccgcaaagacgtccgcaaaccatatcacgaagtcaaaaaagcggaaatcgaaggaacaaaaaaagcgattagagataatatgaataacctggaacaatggatggcgcctaaagaagtcggttcatcgttaagccctgacgcaaacggaattcttatgtacgagcctaaaggcgtcacactcatcctcggcccgtggaactatccgtttatgctgacgatggcgccgcttgccgcttctctcgcagccggaaacagcgcgattgtgaagctgtccgatttcacgatgaacacgagcaacattgccgctaaagtgataagagacgcttttgatgaaaaagaagtcgcgatttttgaaggagaggttgaggtggcaaccgaactacttgatcagccgttcgaccatattttcttcactggaagcacaaatgtcgggaaaatcgtcatgacagcggctgccaaacacttggcatctgtcacacttgagcttggcggcaagagcccgacgattattgacagtgaatacgatctgatggacgcagcgaaaaagatcgccgtcgggaaattcgcaaacgccggccaaacctgcatcgcacctgattacctgttcattaaaaaagacgttcaggacaggttcgcggggattttacaaacagtcgtcaacgctggatttatggaggatgatcataccccagaccgcagcaaatttacgcagatcgtcaatgaccgcaacttcaaccgcgtcaaagatctgttcgacgatgccatcgaaaaaggggcggaagtggtgttcggcggcgtatttgatgccagcgaccgcacgatctcgccaaccgttttgaaaaacgtcacgcctgatatgaaaatcatgcaggaggaaatcttcgcaccgattctgccaatgatgaactatgaagacatcgacgaggtcatcgattacgtaaatgaccgcgataaaccgcttgcactttatgtgttcagcaaaaaccaagacctgattgacaacgtccttcagcacacgacatcaggaaatgcggccatcaatgatgtcgtcgtccatttcagtgacgtcaacctgccattcggcggcgtcaacacaagcggaatcggctcctatcatggggtatacggattcaaagagttttctcatgagaagggtgtatttattcaagcctctaaataatcataatgaagagaatctgcatcatcttgcaggttctttttttatctttatatcacctaaataaagagattaaaagtgataaaatacaattttcaaacgagacaaaattcctctagtctatctcattgaaaccctgcagcccctaacgtataatacccagaaaactttaaaggagtaaaatgatacatggaaaaaccagcaggattttggattcgggcagccgcctctattattgatgtatttattatagctatattctctttcattatgattttattaacaccttcattgtgttgccactcattgatgcagcaggtacacacatgtcagaagcccgatatgagtttttcatgttgatcattggcacaatccctgttttggccatcatatttattttcgctattctttactatagcttgctgacttcctcaaacatgcaagcaacattgggaaaaaaactcatgggcatcatcgttgtcaatcagtatagcgagcgtatttctttttggcacagcttcggccgtttcttcgcttacacattatttaagatcttatatatcggttttatcatggcggcctttccctctaaactggcattacataattatatttgcgggacaaaggttgtctataaaaataaatatcttgattgatcaaaaaaacaggctgccgagttaacctcgccagcctgttttactatttcccaaaagccatcagcttcgtataacttccaatataaagcgttccgtcctcagcgagctgaggagatgacactacgttgctgtcggtttgatatttccataattcattgccgtttgcgtctgccgcataaaccttcatatcatctgacccgaaataaaccgttcccttcgcgtcaatcagcggcgccgttctgacagggccgtctgtgtagaatgaccagttcatatccccgtttttgctgatggaaaacagctcgccgcttcctgagccgatgtagatattgccattatgatcaatcgcaggagatgagctggagaacccgtttagcgggaatgtccatttcaaactgcctgttgatgtataagcatacagctgtccatcttggttgccggcataaatgtttccgtccttatcaatcaccggatatcctttaaacgcatttgacgtcgttctggaccatttcacctgtccggttccggagttgatcgcataaaacacgtaattatatgtgccgacatacacggtgccgtttttggcaagcaccggcacagagctgacgacaccatttgttttcaacttccagcgctctgtccaggttgattttgacgtcggtttgatcgcgtgaacataattatcaagtgttgagaaatacaacgtcccgtctgaaccgatcaccgtttcagagcttggcccgccgcttaacggaaccgttgttaaaatttctcccgtttctttgtcaataaaataaatctttttgtcataggatgccaaatagataacgccgttggtcccaagtacaggagattgcgtatatgtttttccaagattgcccgtcacccatttgactgagccgtctggattaaaggctttcatttccccgtctctggaatgaagatatactgtgccgtctccgtcaatcacagcccccgctccattttgcggagtcgttctgatgtcgttttgccatttcagcgtcccatctgtatttccggcgaaccggctttcgcgtgaccagttaaacatggcaggcgccatcgcttgtacatcatatcttcctggcaaaaagccagatgctccattattttgagaaaacaccgtttccgccgcataagcagctgtcggctgaagcactttggcagcgggcacatcagaaacagcgccggccgaaacagccgccgccaccgcagctcccgcaatcaaagctttcatacgaaatgacttgaccatcattgagacccccattatatgtaacttctaatttgtgaccatcataacatattcatccattttataaatctatttcacaaaaacatcacaaactagaaaactatgtaagagtattcacggacgttttttcagcacccggccgaaatgcagccacaaaccaaatgacgttgacagcagccgcagcgagactaattccgaaaacaaagatcacctcagaaagcagatggtcactaaagaaactaaacatcaagataaaaccggccgaagacaaatgaatcaaaagcccgaagccgcaaagcaccgccatgacatacctcattgcatcgactccgagcatataaacgagaaatggaatgaaatacaatacaaggatcataccgacagctgaccacatgccagctgaattaaactgattggccgccgctcccgttccggccagcggcgtaagtgaagccgccactatcacggcgcaaaaaagaaacgcagaaatggttgtcatgatcgccacgctattttttttagacatcaaactcctcctttaatagaaatattaacctttttcattataagtaagttgaatgttatattcattatattttttaaaaaaatccagatcgtacaaaaatgatatgattctttctagtatatttatatagtaaaaaacaaaggataaaagactcatttttctgtaatatcaggattttatcaccataccatattgcatgtacttgtttttcaaagtatactattccagattaattcagaggagagagaaaaatacatggaaaaaccagcaggattttggattcgttttttagcttattttattgatggcattattgtatctgttcctagttatattattctatttgtgatcaattctgtttttgtagctggggctgtggcaacaaacccttacatgacggaagaagagtatttagtgaaatacatgacgcttgcatttttgcctactatgctgatcatgatcgtcatcagtgtgttatattacgggctgctcacagcttctaaaatgcaaggcacacttggcaaaaaaattcttggcctgaaagtggtcaatgaacaaggtgaacgggtttctgtcggacagggaattggccgttactttgcctatatcttatctggaatcatcttttatatcgggtttatcatgatcgcctttggagagaaaaaaggcctgcatgacatcatttgcaaaacacgtgtcgtgtataaataatagaaaaaagtctagacgccaataggcatctagacttttgttttctttacaataggctgccacgacagatacgtagcgcttctccacagccactcaaacggccccatccgaaagacacgaagccaaaggtggctgaagaccatttgaacggcacaaaccgtaattgtaatgagcacaccggcagcagggtacacttttccatacaggcccaagccgtaatgataaaaaatccaagtacacacaatagactgcatcaaataattggtaaatgccatcctcccaacagcggagaatgattgcagcactgttctcactcttgttttatgataaagatagacaaccgttgtaacatagaaaaacatgaggaaaggcgcgccaatcagcagaaatagttccttttccgttacactgtacagcacatgggcgccgatgccgatgacaagcccagccatccataatcgttttaatcctttgcgatgcttttccggttcatgcaaataccgtgattttgctgccgcagctcccagcaaaaacatgctgaaataaggaatggatgcaaagaagaagttgagcggattatacgtaagcatgccattcgaagacatataaacaagacggtcatggatccgctgttctgcaatgtccttcaggctgccgcttccataaacatgaatcgcttgtgttgcctgctgtgttaccgcttgtacccattcctgtccgtttgattgatcaaaacttgtcaacatgaacggaatggaaaacagaagatacaaagagaccgcccatatcagcagtgttttcggctttgcttttcgaaacaagagcaggacaaaaccgagcaaggcatattctgttaaaatatccccgtcccatatcaaaaaggcatgaatcgttccaaacaagagaagcgccattaaccttctcacatataacggaacaaaccgtttccctttgttttctgctctctccatcatgacaaccatgccaaatccaaataaaaaggaaaacaataaaatacattttgtttgaatgaagaatttcagtatgtctgcggcggcaaaatcagcttcagaccacttatccatgaaaaaattctcttttccaagcatagacaaatacatatccggataactgaaatgtgccagattgacaaataagatgccgaaaatcgccattcctctcagcacatcaagcacaccgatccgctcatttgttaaagtcggctgtaatgaagacatagccatcacgctccttttttctgtaccttaagggtatgaaaaaatgaagcgcggaaacatcgatttaggtgtcaggccggcatgaaaaccttacaatcttgtcatctttatggtttcatcacctttaaatctaatgcttcgatattctgcaaaacgcgatcaaaacgcaaagcctgaggctcacatgggaagatgtggccttcatacgggtcgcctaacgtccggaaaaacggttcaaataaaccaggaaccaatacgcccaccatctttgtatagtaagaatcaaggcgataggagtgaacggtatttgcagggacatgcaggaaatctcccggattcagctgaatttcctggccatctgcccacatcgtcatctggccttcaaggcaataaaatgtttctgtatgatgttcatggtagtgatcaacgattcggtcacctttagggccttcagaggatacgacgataaactggccatctgtatttttttgtgcagccacaatgcggtgaagctgatctccagtcaacaggcgatctccttctccagattcaagaacgtatggaaccgctccatctggcagctctgtaagttccgctaatttggccgaacatgcaggcttttcttcatctagaaatacaatgtccgctacagcggctgcttctgcaaatcgctcgtttgagacttcttcgcttgcgtacggcggatgttcagcgtgatcatacggattcccaataacggaatacaagtgcgctacgtttcctttcatcgtgtaagataccagtcttgttctgtggctctgcatccggtagctgtgcggtgttcccgccggaatgttggcataatcacctgatattaataaatagcgttcaccatcaagtgtcagttccagtttcccgtccaaaacgagaattccttcatgtgtgtccttgtggacgtgaagcggaaaggcatctccttttcccccggaaagaagcacgatctcaaacaaatcacctgtgctcctcccattcgcaatcaccgtggcaacctgtctgccgaacagatagcgctcgccttctccgctccggagcaaataaggcattttttctttgggcaatgaatgtgtacataatgttttcatattatcgcttcctccaatttagaccagtctatatactataactttctgactagaccgttctatataattgtaggagaaaggataacaaaatgctaccctttttttctcaccagcactggtatttgttcggcaatgagaagaagaggcgttttgtctttattcgttaacgaaagcatgatgccgccctcaatcatcgaattaatcagcgttccaagctgatttgcttcttcttctgcaaatccgttttccattaattttctggcaaaaaccgcttcccagcttttaaacaccttcatgcaaaccgtccgtagcggttcactgattaacgctgtctcactcgccagcaaaccgactggaatacctttaatgctttctgtgttgtcaaattggctggctgtttttttgataaaaagctgaatcgcttcaataggatcagaggattcatccatgctttgctgtatcagatgttcaacgatcttacctgtatatgtaaccgcttcaattgctaattcttctttgccattcggaaaaaagtgataaagcgatcccttaggagcaccgctttcttttacaatctggttcaaacctgtcgcgtgatatccttgcagctggaacagacgtgacgccgtgtgaaggattttttcacgtgaatctcctctgctagtcattaaaacattccctcctaggtatggtagagcgacttatataatataaaaaagaaccctgtgattgtcaaaaggggtaagacccttccggatggggtaatgtacaaaaacagcgtctaggagggatctctcaatgacaatcgatcattcagtcacgaatacagagcagcttgaacaacagaaccccggcatgaaaacgaagatcaaactgaaaaaactcaaggatcaggtgatcgtcattaccggcgcttcaagcggtatcggacttgtcacggcgagaatggcagctgaaaaaggcgcaaaggtcgtggcagcagcgcgaaatgaagacgcgctgaaggagctcactgatgaacttaaggaaaaagggcacgacgccatatgggtaaaggcggatgtcggaaaagaagcggacgtcaaccgcatcgcagaaaccgcgatcagcacattcggccgctttgacacatgggtcaacaatgcggccgtctcgactttcggacatgccatggacgtcaccgttgaagacatgaagcgcatgttcgacacaaatttctggggacctgtttacggaacaagagcggctgtcaaacactacactggcagaggtgtgccgggcgcactcattaatgtaggaagcctgttcggagacaggggaacagtcattcaatccacatatgcgtctgccaaatttgcgcttcacggctggacggaaagcatccgaatggagcttgaaaaggaacaggcgcccgtctcggtaacgctcatccacccgggcagaattgacacgccttataacgagcatgcgcacagctacctcgacaaacagccggctcattaccgctccatgatctatccgccggaagcagtcgccgaagctatcctgtttgccgccgaaaaccctaagcgcgacatgtacatcggctcacaggccaaagccatcgccatgctgggcgcgcttttccctcgtctgaccgacagactgatggaaaaaatcatgtatcacagccagcatgccgaaagaccgtccaaaccgcgagaagaaagcgctctttatgatgcgggctgcggtatgcatgacagaggcacaaataaaggatggatgaggtcaagaagctactacacaaaagcgacgaagcgccccattgtatcggcggctgttgttgccggactagtggcttgggctgccgccaaacgatgcagataatctctgaccatgatagaaaaacccatgctgttccagcgaaccatgggtttttcagctgttaatcgataaaagccttgttcatacgctgcagcagctcgccaaacatctctttttcctgtgttgaccattctttcagcatctgttcataacgttcaaggcgcttttgctgatcggcttttaatagttgtttgccgagttttgtaatggtaaacaggctgactctcccatcagatgggtctgagaaacgatagatgagctcctttgcctctaatgcagctgcttgtcttgaaagagtagaaatatcaagcttaaacgattctgccaattccttaacacgagcaggcccaaactcatccaattgtctcagtaataagtacgaagatctctccaaattccctgttcttttctccgattgatccagataaacagctctcctgataaaagtcgtcagctcatattcaattaattcaactggattttgattttgcaatcgctctcgctccctattccaatctccggcattgacaacatcatatatacttgtataatacaaatgtacattaactgaataaatacaagtcgttatatgactaaatcaattattatacttgtatagtacaatcatataaaaagaaagtaaagcgattcctcagaaccatcctagaagcaagcaccagaaaggaggaagctgttctgattggagagcagcacttgatgtgaaagtcatacgaattattttgcaagtgttgatattatatgtattttttatgatcggggaagccattcagcatctgtttcatttacccgtgtcaggaagcatcgttggattggtattgcttctgatctgcttgggcctccgtattgttcccgtctccatcattgaagacggagcagggtttttattatccttccttccattgttgttcatcccggcaatgacaggagtgataaactatccgtctctcatttcattcaatggcctgatgctgctgattacagtcgttctgagcaccatcgtcacgatcattgcggctggattcgccagccagctattagagaaaaaagcaaaaaaacgggaggagaaagagaaatgcagcaagcatgtatcgcgatcattataattcttttaacagttgccgcttatttagcgatggtcaaactctataagcgattcccgcttccatttcttatccctgttctgacaacgaccattttgattgtagcggctttgatgatgtttcatgtttcctatgaaggctatatgatcggggggaaatggatcaattctttgcttgggccggctgtcgtggcactggcctatccgctttataaacaatggcatatcattgtcaaacattgtgttcccattttaggcggcgtcctggtcggattatgcatgggaatgatcagcgggctgatcttcgcagaagcattcgggattgatcatgatctcttattatccattctgccaaagtcgatcacaacccctgtcgctattcagatcgccgccggtcttggcggcgtcccttccatgacagtcgtatttgtcatgattgcgggcttttcaggcgtcatcctcgggccgcttttcctaaaatggcttcgcatacgcagttccctaggacaaggcattgcattaggcagcgcctcccatgcactaggcacctccaaagcattggaatatggagaactggccgtctccatgagttccgtctccatgacgctttgtgcggtgctcggctcattcttcggcccgctcgtcgtctggctgtttcatatttaacaaagaaagactgccccgggggagggcagtctttttcgtttaagaagcaaaaaaatcaatcagcggctgaaagtccttagataaatcaacgtcattcggttctgcttgaagcaggcggtcaatcatacgctccagctcctcaacatcattcttatccgtatattcaatgaagtttaagctttcaagccaatcccgatatgaatgtttggctttgccatagctgtttccaaagacaaggcaaggtgttttggtgataatcgagaaaatcatcgcgtgaaggcggtcggtaatcaccaatttactggagccgatgcggtccagcatctccataaaatgcttttcacgatcagcgtaatcgatggtgtctaccgtatccagcaccgtatcggtacgctctgtgtaagttgttttttctgcccattgcttcatctgtgaaataaaatcttcgtcagtcactttctccttatccgctcttaaaataaagagaacgccgtcccgctcgagctctcgcggcacaatatccaaggaaagcaccatgtccggtgtaaagatcacattggagttgaaggtctctttcacaacatccagtgtttgcgtctcacgcgcagcaatcgttaagtttgtattttgatggtacgcatcctgtgtttttttcttttccttctgtccttcctctgtatcctcaaaataaacggattgtggcagagaaattgatttgtagtctttaaacgccgaaaagacctttcttctgtcttcctcaatatcgagataaaggtttcctaagttccctccgcctgtaaagcagacaatatcgtcttcacgaatgatctccttcaccagttcaatgccctcatccgtcgcataatccataatctcaatgtattcataatacggaaaatgatttttgataaatttctcttccgcatacgcaatcgcttggtctccaatgtttgtgtaactaggggaaccaaacaaaaatacttttcgtttatcatttaacagagcttccggctccacatttggcgcaatgccttttactagttttttgcctttgattttttgtacagtcatatctgcgtcctccttctgggatgaattcctcattgtgtgttaactgtctctacccaaaaagaaggatggctatgcattggcatgtgcatcggctatatcagaaacatcgttttcgccaatttgatagacgctgcaatgtcccgcgccgttctttccatatattccgcggcatgttcaaacgcatcttctagcggcacggctccggggacgatgctgaaaagcgcatcgattccgtgttgatagacggcatcactgtcacgtgatactgatcccgcaataccgatgacaggcacatcatatgatttagccgccttggctacgccgatcggcgtttttccatgaaccgtttggctgtcgatccgtccctcgccggtaatcacaagatctgcatcctgaacgatactttcaaaatcaaccgcttcaaggacaatatcaatgcctcttttcaggtcagcctgaagataagtcagcaggctccatccaagaccgcccgctgcaccggcgccctctgtatctcggaaggttgatccgagctctttttctgtcatatcagcgaaatggcttacgttctggtctagtacatccagcatgtcggccgtcgcgcctttttgcggcccgaaaacagccgtagcgccctttggtcctgttaacggattgtccacgtcacaggcaacttccagtttgacattccgcaatctggaatcaagcccgccaacatctattgatgcaagctgagataacgcgccgcccccgggccaatctcgcggcctgagttatcaagaagccttccgcccaatgcctgaatcatcccggctcccccgtcgttcgtggcgcttccgccgattccgatgatcaatcgctccgctcccgcatcaagagctgctccgattaattctcccgttccccttgttgtagtgatgagcggatttcgcttatctacaggcaccagatgcagccctgaagcagcagccatttcaatcacagctgttctcccatctcccatcatgccaaagaaagctctcaccggttcccccagcggccctgtgacaacttgctctatgatccttccattggtcgcatcgaccagagattgaacggttccctcgccgccatccgccaccggcaattttctgtaatcagcacccggaaagaccgatttgaaacctctttctatcgcttcggctgcctccagagctgataagctttccttaaaagaatcaggtgcaatgatgattttcatccaaatcgcctctttcaaaacatgattcacttacgctagttatctccaatgtaccatattccatttagaaataaataccataatgattgggaaaaattttattaaaaattagaaatgaaagtgtttgcataaaagaaatattcacgttatcatacttgtatacaagtatacttcttgagtgaggaaggtgagtgtatgctagactccaaagacctgttgtatcccgcaaaatggctctcaaaagcgtcaaccggagttcgtgtcgcatacgagctgagaatgcggatcgtttcaggtctgattgaaagcggtaccattttatcagaaaatacaatcgccgccgagttttcagtaagccgttcgccggttcgcgaagcgctaaaaatactcgcatccgaaaaaatcatccgcttagaacgaatgggagcggtcgtaattggtttaactgagaagaaaatcgcggaaatttatgatgtgcggttactattagaaacatttgtctttgaacggcttgtcaaaatagacattgagcctttagttaaggatctcagcaaaattcttgaaatgatgaaagtctcaatcaaatatgaggacgctgacgaattttcatttcaagatgtgctgttccatgaaacgattatccgagcgattgatcattcatacattcagatgatctggaacaatctaaaacccgtcatggaaagctttattcttttatcgatgcgggtacggttaaaggaaaagtatgaagacttcacaaggatcttagataaccacgagctttatattcaagccatcaaaacaaaggatagggtgctgatgattcagtctcttcaccaaaactttgatgatgtgcaggataaggtagaagacctatggctctcacaacaaatgctggcaaaaggagctgaatacaacaatgactagttatatgttaggaatcgatatcggcacgacaagcacaaaagctgtgctgttcagtgaaaacggagatgtggtacagaaagaaagcatcggctacccgctctatacaccggacatctcaacagcagaacaaaatccggaagagatttttcaggcagtcatccatacaacagcgagaattacaaaacagcatcccgaaaaacaaatctctttcatttcgttcagcagcgccatgcacagcgtcattgcaatcgacgaaaatgacaagccgctgacgccatgcatcacatgggccgacaacagaagtgaaggctgggcgcataagatcaaagaggaattgaacggacatgaggtgtacaaacggacgggaacaccgattcatccgatggcaccgttaagtaaaattgcctggatcacgaatgaaagaaaagaaatcgcttccaaggcaaaaaaatatatcggcatcaaagaatacatttttaaacagctgttcaatgagtatgtcatcgattactcattggcatcagcgacaggcatgatgaacctgaaaagcttggcttgggacgaagaggcactgcgcatcgcaggcatcacgccggatcacttatccaaactcgtgccgacaaccgagatctttcagcactgcagcccggaaatagcgatccaaatgggaatcgatccggaaacgccttttgtcatcggggccagcgacggcgtgctgtccaacctcggcgtcaacgccattaaaaagggagaaatcgccgtcaccatcggtacaagcggtgccatccggacgattattgacaagccgcaaaccgatgaaaaagggagaattttttgctatgccttgacggacaagcattgggttattggggggcctgtgaacaatgggggcatcgtccttcgctggatcagagacgagtttgcctcctccgaaatcgaaacagcgacacggctgggcattgatccatatgacgtgctgacgaaaattgcccaacgcgtcagacccggttctgacggtctgctgttccacccatatctcgccggagaacgcgctccgttgtggaatccggatgtacggggctcatttttcggcctgaccatgtcgcataagaaagagcatatgatacgcgcggcattggaaggcgtcatttacaacctgtacacggtgttcttggcgttaactgaatgcatggatggcccggtaacccgcatccaagcgacagggggatttgcaaggtcggaggtttggcgccaaatgatgtctgatatcttcgaatcagaggttgtcgttccggaaagctacgaaagctcatgtctcggcgcctgcattttaggcctgtatgcaacaggaaaaattgactctttcgacgccgtgtccgacatgatcggcagcacatacagacatacgccgatcgaagactcagccaaggaatacagaacattaatgccgattttcatcaatctatcaagattattagaaaatcaatatacacaaattgcagattatcagaggggcttaatcacacacaaatagtacatgacatgaaggggagggcattaccatgccgttaatcatcgttgcacttgggatcttagcattactatttctgattatgggcttaaaattaaacacatttatttccctgctggtcgtatcgttcggcgtggcactggcactcgggatgccgttcgataaggttgtcagctccatcgaagcagggataggggggactcttggccacatcgcgctcatcttcggactcggtgcgatgctgggcaagctgatcgcggattcaggaggcgcacagcgcattgcgatgacgctcgtcaacaaattcggcgagaaaaatattcaatgggccgttgtcattgcctcatttattattgggattgcgttattttttgaagtaggactggttctattaattccgattgtctttgcgatttcaagagaattgaagatttctattttatatctcggaatcccgatggtcgcggcactatccgtcacacacggtttcctgccgccacacccgggacctacggcgatcgccggtgagtatggcgcaaacattggagaagtgctgctgtatggctttatcgttgctgttccgacagtgctcatcgcagggccgttatttacaaagtttgcgaaaaaaatcgttcctgcatcatttgcgaaaaacggcaatattgcatcactcggcacacaaaaaacgtttaaccttgaagaaacacccggctttggaatcagtgtctttactgcaatgctcccgattatcatcatgtcggtcgcgaccattatcgacctgcttcaagaaacaatcgggtttgcagataacggaattttagcttttatcagattgattggaaacgcatcgactgctatgattatttcgttattggtcgcagtctatacaatgggcatcaagcgcaacattccagtcaaaaccgtgatggattcttgttcaactgccatttcacaaatcggcatgatgctattgatcatcggaggaggcggcgccttcaaacaagtgctgatcaacggcggtgtcggcgattacgtagcagacttattcaaagaaacggcattatcgccaatcattctggcatggctcatcgcggcgatcctgcgcatttctctaggctcagcgactgttgccgcactaagcacaacaggtctggtcattccgttattgggccattctgatgttaacctggcgttagtcgtactcgcaacaggcgccggaagtgtcatcgcttcacacgtcaatgacgccggcttctggatgttcaaggaatacttcggattaagcatgaaagaaacattcgccacatggacattgctggaaaccattatttccgttgctggactgggattcattttattgttaagtttagttgtatgaaattaagaaggagctgtaacacatgttcaattcgattggtgtcataggcttaggcgtaatgggaagcaacatcgccttaaacatggcaaataaaggtgaaaacgtcgctgtctataattacaccagagatttaacggaccagcttatccaaaagctggatggacaatctctcagcccgtattacgagcttgaggactttgttcaatcgttagaaaaaccaagaaaaatctttttgatggtcacagcgggaaaacccgtagattccgtcatccaatcattaaagcctttgcttgaagaaggcgacgtcatcatggacggaggaaactcccactatgaagacacagaaagaagatatgacgagctgaaggaaaaagggattggctacctgggagtcggcatttccggcggtgaagtcggcgcattaacagggccttccatcatgccgggcggagatcgcgacgtctatgagaaagccgctcctatcctgacgaaaatcgcagctcaagtcggagatgacccttgctgtgtctatatcggaccaaaaggggcagggcactttacaaaaatggtgcacaacggcattgaatatgcagacatgcagctgattgcagaagcgtatacgtttctaagagaaacgcttcatctgccgctagatgaaattgcatctatatttgaaacatggaatcaaggtgagctgaaaagctatttaatagagattacagctgagattttacgcaaaaaagacgaaaaaacagggcagcctctgatcgatgtcattcttgataaaaccggacaaaaaggcactgggaaatggacgagcatgcaggcgattgataacggcatcccgtccacgatcatcacagagtccttgttcgcccgctacttgtcatccttaaaagaagaacggatggcagctcaagacgtattagcaggcccggaagccgaagaaaaacacttggataaagacacctggattgaatacgtcagacaggctctttacatggggaaagtatgcgcctatgcacaaggctttgcccaatataagatgtcatctgagctttacggctggaatctgccgctcaaagacattgccttgattttccgaggcggctgcattatccgcgctgatttccttaacgtgatcagcgaagcattcagtgagcagccaaatctggcaaacctgctgatcgcgccttatttcacagataagctccatgcctatcaaacaggcctgcgaaaagtcgtttgcgagggaatcagcactggaatctccttcccatgcttaactaccgcgctctcttattacgacggctaccgcacagggcgttccaatgcgaacctcttgcaggcgcagcgcgattactttggcgctcatacgtacgaacggactgatatggacggcgtcttccatacgaattggtctgaataacctgtcatcaaaaacacggtcagttttcaactgaaccgtgtttttttcttctatcccaaacaacagaagacataagttatgttttaaatatcataaacagtgatacaataatagctagaaacaatccccaagatcatcatgtgacagcagcttgctgttccgttctattctgcttttggccattgtcctttgcccttgcccatggtgtcataaaatgttcaaatgccaaaacggcctgtcattctgatttacaaaagtccctgaaaaccttgtctaattgagaatcagcctctcatttgttataaaagaaatgcataaatcctacctgtcacaccttaaataagttgaaaaaaagtaggttatcgcttgacaaaaaatatatattaattaataattcatatataattagaattattattgaaagcgaatatgctttctaatacatttttaggaggaatatacattatgtctttaatcggtaaagaagtacttccattcgaagcaaaagcattcaaaaacggtgaattcatcgatgtaacaaacgaagatttgaaaggccaatggagcgtattctgcttctacccagcagatttctctttcgtatgcccaactgagcttgaagatcttcaagaacaatatgctgctcttaaagaattaggtgttgaagtatactctgtttctacagatactcacttcgtacacaaaggctggcatgacagctctgaaaaaatcagcaaaatcacttacgcaatgatcggtgacccatctcaaacgatctctcgcaacttcgatgttcttgacgaagaaactggccttgctgaccgcggaacattcatcatcgatccagacggcgttatccaaactgttgaaatcaatgcaggcggtatcggccgtgacgcaagcaaccttgtaaacaaagtaaaagcagctcaatacgttcgtcaaaacccaggtgaagtttgcccggctaaatgggaagaaggcggcgaaactcttacacctagccttgatctagtaggtaaaatctaaggagtgcattcaattggtacttgatgcaaacatcaaagcacaattaaatcaatatatgcagctaattgagaatgacattgttctcaaagttagcgcaggcgaagatgacacttctaaggacatgctggctctcgttgatgagctggcttccatgtcatcgaaaatttcagttgaaaaagctgaattaaacagaacgccaagcttcagtgtcaatcgtgtcggagaagacactggcgtgactttcgccggtatccctctgggccacgaattcacatcattagtgttggcgctgctccaagtgagcggcagaccgcctaaggtggaccaaaaagtcattgatcaggtgaagaagatcagcggtgaataccacttcgaatcttatatcagcctgacatgccacaactgtcctgatgttgtacaagctttaaacatgatgagcgtgctgaacccgaacattacgcacacgatgattgacggtgcagcatacaaagcagaagttgaaagcaaaaacatcatggcagtgccgaccgtttacctgaatggcgaatccttcggaagcggccgtatgacgcttgaagaaatccttgcgaaaatgggcagcggcgcagatgcatctgagtttgctgacaaagagccgtttgacgttcttgttgtcggaggcggacctgctggtgcaagtgcagcgatctacactgcacgtaaaggcatccgcactggggttgtcgctgaacgcttcggcggacaggttctcgacaccatgagcatcgaaaacttcatcagcgtcaaagcgacggaaggaccgaagcttgcggcaagtcttgaagagcatgtgaaggaatatgatattgatgtcatgaaccttcagcgtgcgaaacgccttgagaagaaagatctgttcgaacttgaactcgaaaacggcgctgttctgaaaagtaaaacagtgatcctttcaacaggtgcacgctggcgcaatgtcaacgtacccggtgaacaagagttcaaaaacaaaggtgtcgcatactgcccgcactgtgatgggccattgtttgaaggcaaagacgttgcggtaatcggcggcggaaactctggtatcgaagcagcgattgatctagcaggtattgtgaatcatgttactgtgctagagttcgcgccggaactgaaagcagacgaagtcctgcaaaaacgtctctacagcctgcctaacgttactgtcgtgaaaaacgcacaaacaaaagaaatcacaggtgatcagagcgttaacggcatcacatatgtagaccgcgaaacaggcgaagaaaaacacgttgaacttcaaggtgtattcgtccaaatcggtctcgtgccaaacacagaatggttagaaggaacggttgaacgcaaccgcatgggcgaaatcattgtcgacaaacacggcgcaacaagcgtaccaggcttatttgctgccggcgactgcacagacagtgcgtacaaccaaattattatttctatgggatcaggtgcaactgccgccctcggcgcgtttgattacctaatccgtaactgataaaaaaatccgctatattgccagattggcaggatagcggatttttctttttctacagaaaaaacccgaaccaggcactccggtaaaagtgctcgattcgggccagcttcttataggtcctcgccattcgtttgaatgacatttttgtaccactcaaaggaatctttcttataccgcttcatggatccgtttccttcattgtcacgatcaacatagatcatgccgtagcgttttttcatttcgccagttgtgaaggagacaatatcaataatgccccacggcgtgtagccaattaaatcaacaccatcgtacgtgaccgctttttctaatgcttcaatatgcgattttaaatattgaatgcgttccggatcatgaaccttgccgtcctcctccagcgtatccactgcgccaaagccattttcaacgatgaataacgggatttggtaccgatcataaaaacgatttaacgtatatctcagcccggttggatcaatcgcccatccccagtcactcgaagtgatatacggattttcgacaccattcggcaagccgccattgacaatatcgccagtgttatcatttttcacatcgcttttcacagttgttgacatgtaatagctgaagcctaagtaatcgacggttccgtttcttaaaatctcatcatcgccgtcttcgaatgtgatgttgtagccttcgcgttcaaattccttcaacgcgtagcttggataataaccgcgaacctgtacatcagggaagaaatagcgctgcctcatttcttcttcagccagcatcacatcttcaggattggaggagaaaggataaatcggcacgtgtgataccatagccccgatctggaactctggattgatgtcttttccttttgccactgctaaggcgctcgccactagttcgtggtgtgccgtttgatacatgacctccttggcgttttcgttttcgccaaccacaacacctgaattcgtccataggaacaacggattgttcacatccatttggttgttgatctcgttaaatgtcatccagtactttactttatctttgtaacgggtaaagcaagcctctgcaaagttgacgaagaagtccacgactttccggtttctaaagccgccatattctcttgccaggtgcagcggcatttcaaagtgagacagggtaatgaccggctcgatcccatgcttcagcaattcatcaaacacatcatcataaaactgcaaaccagcttcgttcggttcagcctcatcgcctttcggaaaaatccggctccagccgatggacgtccgcagacattttaatcccatttccgcaaacaaagcgatatcttccttgtatctgtgatagaaatcaatggcttcatggttcggataaaactcgttctcttcaatcgtatccgtgatttttctcggcacgccatgtgcacctgctgtcatcacatcgacgacactcggccctttacctccttgattccatccgccttcaaattggtgggcagctaaagcaccgccccataaaaaatcctttggcatgtttcccatgtttaattcctcctcagcttacgactgtaaatattttttgatgcaatgcactttcctcaatctcttcaatgaaagctttaacaaactcatcgccttttttgacggtatcgccttcttttaccttcaaggaaaaaggcgtgccgtcaaatgtcaccgtatccagcccgatgtgcgcaagcaattcgacgccggacgctgaacgcagctttgtaggcgccaccatgacaaccgtaataacgccgggatggtggcatcgattttacgatatccttcgctttaggggtagaccgcttcagcaccaatcgaagtctggtagcgcagcgagaagccccaatcacattctcttccccgcctacggcctctaaaatgtcttttgctagtctcgtataatctctcacttccccgacatttcacccacccctttgatttggttgcgctttcattataattgtaccggtataatatatcaataccgaaacaaaatatttacgcactaactatcattgtaagcggtttatgctataattttggcagtgaaactaaacgaataaatgaggaatgcgtatgttaaaataccagcaaatcgcagcggaaattgaaacatatatagaagaacaccagcttcagcggggagacaaactgccagtcctagaaaccctcatggcccagtttgaagtcagcaaaagcacaatcacaaagtccctcgagctattagagcaaaaaggcgcgatctttcaggtcagaggaagcggcattttcgtcagaaaacataaacgaaaaggctatatcagccttctgtcgaatcagggatttaaaaaagacctcgaggatttcaacgtcacctcaaaagttatcgaactagacgtgagaaagccaactccggaagcggcggaaaacctgaacatcggaatggacgaggacatctactatgtcaaaagggtccgttacatcaatggccagaccctttgctacgaagagtcttactacaacaaatcgatcgtgacgtatttaaacaacgaaatcgtctcccactccatcttccattacatccgggaaggactggggttgaagattggtttttctgatttgtttctgcacgtgggccagcttaatgaggaagaagcggaatacttgggattagaggctggactgccgaagctgtatatagaaagtatttttcacctgacaaatgggcagccgtttgattactcgaagatttcgtataattataagcagtcgcagtttgtcgtacaggctaatagttttttgctgtagagctgcttcactatggaaggtggtcgacatgaacaaaatcatcattcctgcaatactagccatctttgcgctctggatattcttacagatttcactagagatgagcatcgttaagaatccaatgaactactttatcgtattcattatctttttcctctttgtaaagatggtgaaagaaaaacaataatagtttactttgaacaggaaaccagatttgacatctggtttttttgtgtttcactttattcatccgtttcaattgtctctaaaagcagttatgcggtactatcatataaaggtccaatgtttaaaaataatgtcatacttttaaattcaccttatcatgcacatgatcatatataggggtttattctaaaaaggggatggacgattttggaaagcaagtacctagatctactcgcgcaaaaatacgattgtgaagaaaaagtggtaacagaaatcattaatttgaaagcgatattgaacctgccaaagggcactgagcattttgtcagtgatttgcacggggagtatcaggcattccagcacgtgctgcgcaatggttcaggacgagtcaaagagaagatacgcgacatcttcagcggtgtcatttacgatagagaaatcgatgaattagcagcattggtctactatccggaagacaaactgaagttaatcaaacatgactttgatgcgaaagaagcgttaaacgagtggtataaagaaacgattcatcgaatgattaagctcgtttcatattgctcctccaagtatacccgctccaaattgcgcaaagcactgcctgcccagtttgcttatattacggaggagctgttatacaaaacagaacaagctggcaacaaggagcaatattactctgaaatcattgatcagatcattgagcttggccaagccgataagctgatcaccggtcttgcttacagcgttcagcgattggtggtcgaccatctgcatgtggtcggcgatatttacgaccgcggaccgcagccggatagaattatggaagaactgatcaactatcattctgtcgatattcagtggggaaatcacgatgtcctttggatcggcgcctattccggttccaaagtgtgcctggccaatattatccgcatctgtgcccgctacgacaacctggatattattgaggacgtgtacggcatcaacctgagaccgctgctgaatctggccgaaaaatattatgacgataatccagcgttccgtccaaaagcagacgaaaacaggccagaggatgagattaagcaaatcacaaaaatccatcaagcgattgcgatgatccaattcaagcttgagagtccgattatcaagagacggccgaactttaatatggaagagcggctgttattagagaaaatagattatgacaaaaacgaaatcacgctaaacggaaaaacatatcagctggaaaacacctgctttgcgacaatcaatccggagcagccagatcagctactagaagaagaagcagaagtcatagacaagctgctattctctgtccagcattccgaaaagctgggccgacatatgaattttatgatgaaaaaaggcagcctttatttaaaatataacggcaacctgttaattcatggctgtattccagttgatgaaaacggcaatatggaaacgatgatgattgaggataaagcctatgcgggtcgtgagctgctcgatgtatttgaacggttcttacgagaagcgtttgcccacccggaagaaaccgatgacctggcgacagatatggcctggtatttatggacaggcgagtactcctccctcttcggaaaacgcgccatgacgacatttgagcggtatttcatcaaagagaaggaaacgcataaagaaaagaaaaacccgtattattatttacgtgaagacgaggcaacctgccgaaacatcctggcagaattcggcctcaatccagatcatggccatatcatcaacggccatacacctgtaaaagaaatcgaaggagaagacccaatcaaagcaaacggaaaaatgatcgtcatcgacggcggcttctccaaagcctaccaatccacaacaggcatcgccggctacacactgctatacaactcctacggcatgcagctcgtcgcccataaacacttcaactccaaggcagaagtcctaagcaccggaaccgacgtcttaacggtcaaacgattagtggacaaagagctcgagcggaagaaagtgaaggaaacgaatgtgggtgaggaactgttgcaggaagttgcgattttggagagtttgcgggagtatcggtatatgaagtgagggatgtggggttcagggattatattctttgggcccatttttacaatcaactataaatcaacaaaaagcctctcaaaatagggttttgagaggctcactatcaaacatgaaaagtacttctattagtgttaggtcttatgacttgatctacattctcagcaatcgatttataattttgtttttttgataaacgatcataatccccaacaatataaaactctttttttgcccttgtaactgcaacattaattaaattaggctttgagcacgaccaatttgccgctccatcactattttgatctgtccccactacaaagtaaacagtgtcggcttcttttccttgaaaggtatgggtagttcctattgagcttcgagtccaatcatttactattttctttggtacatttaattctgctaaccgctttttaattgtttttctgagaccatctttcactgctgtaaagggagtaataacatataaatcaggagcatttaatgtattttcccatttttgataaatctcttcagcaactaaatctgcctgctcttttacaaactgcttattaaccgctactcccttacagtcaaaccattcgcttttcccttgtttttttatcgctaaaaccattttattatcataagcaatttgattagcgattgtaaacattggatttaagcatctcctatgaacccataaaggtatccctatccactgtcctttattgttatacattccaaatggattcgccgcatccgccagtgattgtacagaactccctatttcaataaaccgatcttcaataccataaaatttttttatatctcctaatattgttcgatcaatggtgacaactggttcaatctggattggatcaccaacaacgacaactttttgagacctccataatgcgcctgccgcttgttgcggagtagcttgtcccgcttcatctataaataagtaacgaataaaatcacgaccaactcctttatacattgttcgaacactggcaaaggttgtacttattacgggtgtgattaaatggattacaccccacatatgttgtaaccacattctgtgctcagtctgatttaaatctaacttacttcgataatttaacaaacgcaaacttgattttattgctttataattaaatatcaaaaacaatttgtggactttcattccctttaaaaaaagaagccctctttcaaaattcaattcatcagttagccaaggagtatgtaattgcctatattcatatgcactttgagaattggtccaataattatcatcgggtattactaacccctgatttttgcatttattgttgatagaatccctatatttctttaactccatccttatttgattcgatctcatctgcaaaagatcccattccttttcttcattttttattttcatagttattttttgcagttgatcttccatctgtaataatttgtttctttttgtatgaaatattctttgaaaaaaagttggtttagaaagcgtgtgaaactctctctctaacaaccgtttctgttgtttataatgagctgtctttaatactaacttttcttgttctgcctctagtaacaataactgattatttatatccttatattttttaaaaatttcgcataacgattgtagttctgctttcttttgtttaactgatttcaatgtttgttggaaatctgttactgcattcttccaatctgttaagcttatttttttattttctcgttctaattgctcgatgaatgatagttcaaattcgttattatttctataataaagttttttgtaatagtgagatatattttccgactttcctaaagatgctgagaatagtccccaagtatctgtctcttcacctagaagagcctttgccgcaaaaggaaacatcgataattcctctgcttctaatgcatatgctttttcataagaagaaaatacattttcatctgtaactttacgtataacttccttctttttaggaagatcttttgagatattttcaactgctccattattgcttgaagccactaccatagaatactgattaatagatttatcaatttcataaatagtataatgatagccatctaaaactaatttctttatttttttcagagctttttctgggttttcaaaacaagccattttttctgctttttcaaccatgagatttgcaaaaatatcttttaacagtgtcgttttccctgttcctggcgggccattcacagagcttatcttttgattgttatttataatttgatttacagctacttgctgcattaaggataatctatgttcaacaggtgacggccacctgccgttaggtacatttttaggctgcaacacatcttcaattaaaactctattttcatcaatgttcgttctattatcaaccccttcaataaattgccgtagtgtttcattttctccttgtgagataatatctcctaagtcctctaagaaaaagctatgaaaattatttacccgtccatcttgtccaaccttcaaaatttctttctcaaaataatgaagcgccatattatctattcgtaaaaaataccgttcatatactccaagtactttcttaagggctttttctgttactccatttacaaagatggcatcaacctgttcctcaaataatctcaactgatctcgaaatgtagtcatcaaatcatcatatggcacttcaagatgttcgtttattaatttcatcacatacataagtacaggtacaaatgcagaatcctttacatacttgcctgtatggtcaactaaaaaagacatactaaataacattttctgatctctattaatcatttcttcattattttggaatagatcacgtagatagctaacaagtttatgttgctcaaagcaacctaaatagtaacgaaattgaataaaatttttttcagagtccttcaactgatgcctctcccaaggcctttcagaaaaaagaacttgttctgttttctttcgttgttgaccatctaaaaaatggcttctactcaattcatctcctataccattgactccgcttggtgataaagcctcaactaagtgccatgcccttaatacagaatttacatttatcttccccataattccctcctatttttaacaacatcattcggttattgtcctcaattgatccaactggtatctgtaaaaaatccctaaactgattgatcagtctcttttctttttttcgacacatttgtttaaatattgaataattaactagatcacacattaaaattattagattttagaacatttcattttagtaaaaattcatgactgattcataaactctgagatcatttgttaaatttatgatacgatgacagtaaaaaagacataacaggggctagtcatatgagtgaacttgtgtttgaaaaaagagattttaatacagaacaaattcttgcgttgaaggcatctcgattagataacaatccgattgtatacattctttataacgaaaaaaagaagccgactgcatatattgggcagactgtgcaggctgcacgacgattgaaaaatcatttgagagacaagaagcgaataagtttaacgcgaaccattttcattggtcatgaaagatttcatcagtcagcttcctacaatattgagacaaatcttattaattactttattgccgaaaatcactaccaattgcaaaatgtcagtcagacaagatcgagagaaatgcatcattattatcaaaaagaattttataacgaacatctttttgaggaaatttggaatcagcttcggaaagagaatgttgtcagcgacacccttgaaaacctcagaaataaagatatttacaaactatctccgtataaagagctctctccccagcaggtggaaatcaaaaatgaaattcttgatttttgcaaggcgcatattgaaaaaccaggtaaccatgtcatttctatagaaggagatgccggaacagggaaaagtgtcttactgagctctctatttaacacgattcaggatttatctaaagatgaaaattcacatttaaaaaacaagaacaattacttacttgtgaaccatggtgaaatgctgaagacgtataaaagcatcgcaaacagcttaccaaatttaaagaaaaaaaacttaatgaagcctacctcctttataaatcaaatgtcaaaaacaggggaaacagctgatattgtattagtagatgaggctcatctgcttttaaccaaagaggatagatacaataatttccactatcgaaatcagctagaggaaatcattaaacgcagtagtatcactattgtcatcttcgatcctaaacaagtgttaaaaattaaaagctattggaatgaaaggttgcttgaggagatcaccaatcaatatcatgcgaaaacagtaaagctcacggagcaaatgagaatgaatgcaaatccagacacactaaagtggattaaccattttgtctcaaaacaattgctccctctgccgcaagaaaataatgataccttccaactcaaaatctttgaggaccatgccgactttaaagctgcaattgaaaaaaagaataatgaagtaggtctatcacgtattgtctcgacctttgactatatccataaaaaagatggtgctacttatatggtcgatgaggaaggcattaacatgccatggaattctacaaatgacaaatggacttgggcagaacatgcagattctattaaagaggttggttcaatctatactgttcaaggttttgacctaaattatgttggcgtcattctaggaccttctgtcagctataatagtgaaaaggatgagcttttcatcgacactgcaaaatataaagatacaggcgcattcaccaaacgagatgacatgtctgccgagaaaattaagaaaataaaggaagagattattctaaactctatcaacgtcctcatgaaaagaggcatcaacggtctttacatttacgcaacggatgtaaaattaagaaatagattgctagagttaaaaaggagaaggaaaaaatgagcgaaatcaaagatttaattaacacgattaatgaatttagagacgcacgcaactggagacaataccacaacccaaaggatcttgccatctctatttcaattgaagcggccgagctgttagaagacttccaatggaaaagcagcgaagaagcactcaaagcaaacgaggaaaacattcgtgaagaaattgctgatgttcttatctattcgctgatgctttgttcagatcttaagatggatgtgaaagagattattgaggagaaggttgtgaagaacggtcggaagtatccggttcaagggtaattatatttcttacaataattaaagcaatcttcactcctcaaaaaataaaagtgcatgacgatatatttttggaatgattaacaaatagattgattcttctgaatatattgtagctcaacttaccgctgagtgacagaaattaatcatagatactgagtttaaaatttactttggatttactaatgtaaattattaaacttaggattttattaaaacaggcatattcaagtatgcctgtttactactttaagaaagaagtaacctcattcacttatggtaaggctctccgtagtgtatctacttttgttctagttcttttaaaacctttaagtcttcataataccttaacaccgtactttgcattactaactttctattggcagaatctctaatgttacgaaatttctcattataaaacagagtaaaatcatgtattgtgctaaataaggttatgttagcttgtacccattctgataatgtctcatcagaaaaaggtaagtcatttgattcaaaaaataaactatccaacactgacgaataaggtgttacacttgcaaataactcatcttcaaaaatagtctcattttgatactcattaaataatgaaattatagattcagcatatgttatcatttgatacctaatttctttaactttatatagtacttcatcgttaggcttggtattatcaaaaataaaattactaattatcttatattggggataaaactcaaaatgaacaccttttattaaatgtttattagagcctttcaaactataccaataagtcttatcttgattatcgcttacccaagtagttttacaataataatttcctcgtaaaatatcactttcataaaaagtgaaataaatccatattatatctgatggacagcctttatatctatcttcttgtattttgttattatatacatcgcaaaacagtaatctttttttaatttttgttgagacgtctgctatttctgcatccgagaatggtttcttaagaagtatttttgccgcgtacctttttttagaaccatgatggacaggttccacactcttaatgatgtaatcctcgttttcaaggtaaatattatcttttttataaggagtatactctgaaattttaaaataaattgtacctcctatattagctctatatatagcatgctgaggtgtatccggattatttaaagtatgaatctcaagtaacctctttacccacaactgcaaatcataaagtgaaatttctcccttttttattaaaaatttattcgtcagtccatcgcataaaatatttgtaaatatacttccattgctccctccataagaaggttcaatagcgttactaccacttaatatcgcataaccgctaccttgaaaagattctatagattcttctaaattagtgctttttgtaccttcaactctaaaattacctgaatagcagcagtctataagcaatactttgcttttagctaatgactcgcctattttattaattatgtcctgagtacataataaaccatcgctaaaaacaatattatgaatttcactagaagtcccatgacctgagaaataaaaaataaatatatcatctttttgtaaattgccaataaaaagctcaagggcatgtacaaaatcgacgattgctacatgaccgttatttgtcatacccatttgaaaaatatccatatcatccagctgtaatccttctcttaacgctttattaacattaattatgtctgttttacaaaatggtaaatcaggtgcaccgatacctgaataatcactaactcctactataaatgcctttatccttcccatataaatcaccccagcttcacttgtttatctgattaagattgtaataatcatataaatagacaagcccaatttttattaaagaaaattgggcttgtctatattattctggttgttctaatcgtgattgaatgtttttccagtgtttcttcacttgtgtttccataagatttatagtttttgaatcttcatcaaatatcttctgtgctctttcaacgtaactaataaaattcccatgccctttcttactttttcccaagtgagagtagttcttatataattctctcctatacgatttacgaccgaatttttttgatttacgattgcatatccttactttacgatatgctctcgtataatacttaaaaagacttttttctctaattcgaacttctttaccattaaaactgaaccctagatagtctaatattgtctcatttaagtctaaatcgataatctgattatcgttataaaaataattccctgtcttctcaagttgaatttctaaatttggaatctgttcttttatatcttccaaaattttttgatgaatttgatagttatagtcttgaatgcctccttcaataggaataactataattaaatcatcacaatatcttctatatagcccattttgttctttaacatatttttgtatttttttatcaaagtccagcaaataaatattagaacagactgaactgatacccgctccttgaggaattccataccttttagaattcttgtaaatatttttatgcttaaatgctctaaattccttctctgtgaaatatttataactactttcaatttcactttcagtgtattttgtctttaattctgcttctatagtatctttaataaagtaactaaatcttgttatattcttgaagacattataataatcgtcaggtaaggtatccttttttagaacatagcggattttctctttaagatacctatgatccaatgtatcaaagaaattagtaaagtcagcaacaaaaatatatgcactttgctgcacttttataaaatcaataacttctttagcgaagttaatattactttttccagataagttattccgatatgcagttgcaacttcattaatacctagttcatctacaacagaattatagtggttatttagcttgtccccatagtacttatagatatagctatccatatgagacgcatagaaaattttacgaactttttcttttcgctttttttcttttctgctatatttttgaaatttaatttcaaaatgcataaacgggtaaaaaccatgtttagcaacccatcgagggttctggattttactcttaactttttcaattgattttttattatcaaggtgcttataaccctttacacgatactttttttcattcatatttggcagagctagcaggggtatgtaatcgtagcctattactctctatcaaaaaccctgctagcatactctcctttcgaattatagaccattgctagcctataaagaggctactgaatgcactaatagcttatactataatcagtatattaaattggttgtttatgacgattggaggtatccaaatgccaagttattcagaagcgttatcgattgtaatcgactggataagtattatgattacaattgagataaagcttgacagaaattcaccaatttccctcataactacttttatgaggcgttaaccatattaatattaccatctaaaatttaaatagtcaaaaaagtcaatcaaaagtcatgttttgacctaagatctgaaattaggtatcttgaaaaatataaaatatattatgtaaatatatgagttttttatttttagaagtcgatgatcttcaactgatttgggattcaattaatgatactcaactagttttccacccaatataggcatcaaccggatcgattgattatctgaaattagaacattttacgtaggaaaaagaagtttctttaattcttgatagaaacctttttagtagtttattgtctcttgctaaaaatggtgatctaaaagacactacggaaaaaagaatgattgcttttttaatgttatgggctcaattgaatggaggttccaatcagtgctggattagcaataatggaaaatgcatcaagatacaacgattcttgcaatgctaaaatagagctaaataattttaatgatattttcgatttttatccacctcagatttggttaaatttagctcgtggcacaatagaccagattccaaagtgtaactttttcaatattccatatgaaaactcaatcacttatcatgacactaatgatcacttcctaatgaattatgccagcatgttgcatttagttaatatatatcgagactctgacatggctcctttagaaaaattattagaagtcctaagttggaactttgacaatttactcatctctcaatatatcaatagatatcttgttatgttattttccaatcaaaatggtatcaaagcacctaaacacgctaatagcgatttattagaaagaattgaaaaaggttgtatgaatcaagcatgggatttaacctatctatcatgttggagtacactttactggaatgaatcaaaaacgcatgaggtttttttatttgctaccgccgataatctgttaaagaaaatttttattaacacacataatggtagagatttatttaatttaattaatattgcttttcctaaaagaagtgctgataaaatcattcaattctatattgaaaaaacaagaaacagaattttggggataatccaactcaatatttcaaatctttaattgagaaagaaaaaaagcatttgaaacaatctgtgggttgataattttcagctgtattacctaatgtcattccctttgttgtaaattcaaatatacaatacaaactttaatataaccaaaacagtccctcccccatttgttggggaagggactgttttggtatacaggtaaaatctcatctacttatgatacggctccccacgattaatccgaaaagcccgataaatctgctcaactagtatgagacgcatcaactgatgaggaaacgtcatttttgagaacgacagcttctcgtccgctcgcttcatcaccgcgtcgctcaatccgagtgatccgccgatgacgaaggtgactttgctttttccatatgtagccagcttatctattgtatcggctagttcttcggatgttttcatttttccttcgatggcgagggcgatgacgtggacgtcggggctgattttggataggatgcggtcgccttctttgtcttttatgattttcatgtcctggtcgcttaggttttccggcgctttttcgtccgggagttcgatgatgtcgatttttgcgtaggccgaaagtcgtttggtgtattcttcaatgccttgcttgaggtatttttcttttagttttccgattgtcacaatattgatattcacaggtcatccccactttaaaaacaagttattcatatatgttgtccacaattgtggatatcttttctgtattttgtgtaagatcattcgttccccactatatatactgcggggtctccacataattcacaggctgtggataaactgttagtatgttcgatttttctgatttcgggcggcagctcgtggtcgtctatgtacatatccagcaccgtttcgatgtgttcttcacaagaataatacgcttgtttcatgttcaaatcctccgatgttttcttccatttttacaaatgttctcttctcaatataacctatttattcacatgttagtagtgcttcgggctgagttttatccacaattcgacaaacaagctgttgatgactctatttcgctcgtgtgttagtttggatgtaaccgatgtgtgaggaggtctacatttgcgctttagatgggtttggctttttgtgatcatgttgctgcttgctgggtgtcagccgtcttattgggtgttggagaaggatcgaatcggtgaaggcagtccagacttagaaatatacgctaattaccttcaaatgcatgatgatgtaaaaggatatcaagtcttcaccatatcagaaggcaaaaaaatggtcgtcgtgtctctcggaagcagcgagaacgaaaaacagcttgaggtgtcagacgtcaaattctcacctaaagaaacgattgtaactgtgaaacgaaaacctgcttccaaagctaatgagaaaaacccttatattctgattggactcgataaaatcgaaggggatttaattgtccaagacgaaacaggatatcactttgaagaaacagattaccagcaataaagccggcgttctgagaacgtccggctttttcttttacttcaatgtcccatgcgggtcgatgacgaattttttggctgcgcctttgtcgaagtcgctgtagccttttggcgcgtcgtccagagaaatgacggtggcgttgacggcttttgcgatttgcgctctgccgctcaggattgctttcatcaaattgcggttgtatgtcatggcgggtgtttgtcctgtgacgaaggtatgggctttagcccagccgagtccgaagcggatttttagtgagcctgttttagcgtcggcatcctttgcaccgggatcttcggtcacgtataagcctggaatgccaaggctgcctccgacctgggtgacatccatgatcgagttcagcacggcggcgggcgcttctccttgattgccgtgcccagatgcttcaaagccaacacagtccactgcggcatcaacggttggttcacctagtatttgttcaatttgttcgccaaggcggtcgtgtttttgcacgttgaccgtttcacagccgaagcttctcgcctgtgccagtctgtcttcgttcagatcgccgacaatcacggtggaggcgcctaggagctgagcggagtgtgcagctgccaagccgacaggccccgctcccgcgatgtaaacggttgaacctgtttgcacgccagctgtgtaagctccatggaagcctgtcgggaaaatgtcggacagcatggtcaaatcgagaatcttttctagcgcctgttctttatcagggaatactaaaagctgaaaatcagcgtacggcaccatgacgtattcagactggccgccgacccagccgcccatatcgacgtagccgtaagccgatcccggccggtccggattgacattcaggcacacatgcgttttctgcgttttgcacatcacacagcgtccgcaggcaatattgaaaggaacggatacgatatcgccctttttgataaattcaacatcacgccccgtttcaatgacttctcccgtaatttcatgcccaagcaccaagccttctggcgccgttgtgcggcctctgaccatatgctggtcgcttccgcaaatgttggttgtaatgactttgagaataaccccatgctcacattttcgattcacattcgcctttgggacgccgggcccgtccctcaagattaactccggataaccgatatcctccaccgctacagtccctttgcctttgtacacaaccgctttgtttcctgtcaacgccattcctccctttcatgtgtttggacgcttggtccttgaacatgacttcggtttggcatgaccctttccctttctcacgactgttttttctgtattcttataacaacaaatatgccaagaaagcagccaataatggttccgccgatgtctaagaagtcgactttacatccatttaacaggaatacagtaatggccgaaaccaggctgatcataactgccagaagaataacccgtttggtgcgcatgtaattcctcctttagattcgtttctaaaccatacccaaaatcctctgcaaatttcggttcaacaaaaaaagagacttcacaccagtctcttcataattagagatcaattaaaaaatttcctgagaaataatgtgacaatactggttaccaacgcaatcgccgtatacataacaacccaaaacatgaatgagctattacccgaagctaacgtaaataacaatatcaagctcgcgataaggacgatgagcggtgccacccaaaatcttttaaataaaaaatgaccggctataccaaatacacctgcaatgatcggaaaaccaaaaacgataaataaaacggcgatagctcccatactaacctccttgccctaaaaccccttcatcacctcaacatcatacagcttcaaatgactcttcggcgtcacgacatcctttaccttcccaatctctttttctttcattttctttccggttttcagactgtactgttcaatgtaggcaggcttgttatacgtgtatgtgaagtaatagaggctgctgcctttttgggtgatttctttgaaatcggctttcattttgtcctgggaaagggtgaaggcgatgtttgtttttcctgtcttggcatcgattttgtgtacctttccgaagccgtcaatgaaatacaggttcccgtcataagggaaaaagctgtttttaaagctgaagggcatggagctgtatatcgtttgttcgtcgtttttgtattcggcgatgtcgtgcagctctactttgccgctttttttgttgatcttgaccatttgatagagattgcgggctttttggccgcgaaccataacataaacagcttggtcgtccacagcaagctgggattcgactgaggctccttcccggtactgccattccgatatcttgtggtaagtgagcttcttttgatctgcttgaatctgaaggagctcatagcctttttcgtcagctgtcgggacaagtgcgtaaatggcgccatcatggaaaccggaggctcggatgtagtaggggatgacgtcttttttccactctccgtctatttggcggtacagctctgagcggtatccgtctttctttttgtcgtagccggagttgtataaggtgtaaaagccgtccgtgttttgcagaaagcctgcgctgtcgcctgtgtgctgataggttcttttatgagatctcaggccgtctttaatcgtataaatcttgtttttgtcctccagcatcacactgtcgccgtgaaccttggctgatcccagctcaaggcccttcatctgaaatgaagacagcgacccgtcctggctgataaacaaggcatagcttttcccaccgccaaatgcatcttgatccgcagaggttgaaaaatataacaggacttctttgtcatccaagaaaccggagtctcgaagatcctggtgacttacagttttatggctaggagaaatgaagacaaatagtgcgattcctgcgagaatcagcatggcgatggtaatcatccactttttcatatccttctccttagtaaatggtcatgatggttgtcgtatacgaagaacttgtgatgtcgcgcggatacacgcctaagcctccgttgctgtctatatcaatccctgcttttagcaaaaaggcagaccataggagctttgaacagtttttggcgccgtcatggcccgtatttctgttattgacgaagttaaatgagtatgggtcgccgacttttgataccgcccagtcggcagcagctgttttttgagatgaggatacgctgacggtttgcacaatggagttgtcttccacgtctctggcattatacgcgatctgcctgacgccgtcgctcgggacagattcaacaattttgtcagcggcggagtacatgccgacgtggccatgattgtagtaggctgtgtaggagttcgtgtaatagatattgcctttcgcgcttgtcgggagttttttcgtgccggacgacccgcccatgatagacatgccgctttccttggcgagccggtctccttctgctttatcagccgtgatttccttatagaactgttttaggataacgtcctgctttacgtgctgctgtttggcaatctggctggcagatttcatgatttcttccggtgtcgtgcctggctgcagtgcggcgatttcttcagcataatttgtgttctttacggctttggcgggagaaacgaacaggccgccacacattgtaagcgctaccaaaaacatcgacactcgtttcttcaacttcattacatctcctcttttcttgtgagtgtaggaaagggaatttcctcacccacattatattaggaaaataaggaaagtaactaggttatttacagaatttttagaaatcgtttacagaaaaaggcctttatcaggcccttttcgttaaatcttcttgctcatcactacgtctgtttcttgaaatccggtttgctcatatagctttcgcgccgtctgattatgggcaaagacatgaagggacagcttgcggattcccatgctgcgtgccgtttgatctaatgccgccaatgcttgctttgcgtagccctttccccgatacggttcatataacccgaaatcataaataaacgcttcctgctgcggatgctccggttcagcatgtatccagagccagccaacgatatccttttcattcagcttgaggctccacaaatggtgatggggtgtttccagccctctcggaagcagatcagtaaacgcctgcttagacaaaagctgtgcatcttcaggcagccatgttcccgcttttaccttttcttccgcgtaatgctttgttgtgtacgtgagataagaccgaaattcttctgtctgcattggggtcagcatgattgtcatatcatctctccttcatatattgactagaggattttacataaaatagaaagaggtgttactatcagaataagcaactgagattgataagtcactagagaaaggagtttcacatgaataagatcgcacccgcagaaatcgctagcatgctcaacgattggtaccttgccatcaagaaacatgaagttgaagaatcctcccgtttatttgaagaagtgaagcctttattggacgacatggaagaggatcaggaggtgctggcctacttctccttattggaactgcgccacaaggttttgcttcacgaggcgagaggacagggctttcagcatgaggagccttctcatatgaatgctacgtctgacatgctgaaatattacttttttctgtttgaaggcatgtatgaggcctataaaaataattatgacattgccattgggctgtataaagatgcagagcagtatctcgacaacattcccgatccgattgaaaaagccgaatttcacctgaaggtcggaaagctctattataagctgggacaaaatattgtatccctcaatcatacacggcaagcggtcaaaacgttcagggaagaaactgattataaaaagaagctggcttcagccctgattaccatgtcaggcaattttacagagatgagccagtttgaagaagctgaggcttacttggacgaagcaattcggatcacgagtgaattagaggatcatttttttgaagcccagcttttgcataacttcggccttcttcatgcgcaaagcggcaaatcagaagaagcggtttcgaaattagaagaggccttacagaacgaagagtatgcccgctccgcctattattatcattctgcctacctgctgatacgagagctgtttaagatcaaaaagaaagaacaggccttatcttattaccaagacgtgaaggaaaaattgactgctgagccgaatagaatatgtgaggcaaaaatagacattttatatgccatttatgcagaaggaggtcatgcggaaacgtttcacttatgcaaacaacatatggatgacttgttgtccgagaaagagtatgacagtgtaagagaactttccattttggctggcgaacggtatagggaacttgagctttacaaagaagctgcccactttttttatgaagcattacagattgaagaactgattaaacgaacggaggttatataaatgaaaagatttctgattggcgcaggcgtcgcagcggtaattttatcaggttggtttattgcagaccatcaaacccattcacaggaaatgaaagtcgctgagaaaatgattggataaatgaaaaacccccgcgggtgcgggggttcaatttaacgaaagaatcctaaaacggtttgtagttttaggattctttcatcttttcagcgtgattgaaaacccttgaagtctaggaagaacgagcattggagcgcagcgaatgtttggaattcgtgagcaccgaagcgcaggcctgacaacgaatgcgagggtttgtcgacacgctgaaacccccgcgggtgcgggggttttcttattacagcagcttcttccctagcagagattctacgagctctactgctgttttacccgttttgtttttgtgatcaaggatcgggttaacctcaacgaattcggctgaggtaatgatgcctgcgtcatacagcatttccatagccaaatggctctcccggtagctgatgccgccgacgacaggggttccgacacccggtgcgtcgttcggatcaagtccgtccagatcaaggctcagatggacgccatcacatgctgataaataatcaagggtttcttcaatgacctttgtcatgccaagacggtcgatttcgtgcattgtgtacaccttcatgccgctttccttaatgtacttgcgctccccttcatcaagtgaccgggcgccaatgatgacgacgttttccggtttgattttaggcgcgtagccttcaaggttaaccagtgactcgtggccaatgccgaggctgaccgcgagcggcatgccgtgaatattgcccgatggtgaagtttcaagtgtattcaaatcgccgtgcgcgtcataccagatgacgccgagattatcgtaatgcttcgctgtgcctgcaagcgtgccgatcgcaatactgtggtcaccgcccaggacaagcgggaattttttctcttcaatgactttgttgaccttttgcgcgagtttttcatttcccgccaaaacggaattcaggtttttcagttcctcgtcatttttgattttttcgcggttgatcggaatgtcaccgagatcctcaaccgtataccccatgtctgacagccgctcgatcagatgagcgtaccggatggcactcgggcccatatctactccgcgtcgtgcttgtcctaaatccattggcattccaataaccgaaatcgttttatccatctgtgattccacctcaacatttaagataatgtcctatgcgggttctaacaaagatgacttacggacaacgttttaaagctctagctgacgattcgcctgctggcgttttttaatgacgacatgataaatgatgtagcaaatgatcataaacggtacgccgcaatacagcgcgatacgctgctccggatcaaatgcgagactgatgagcacgaccgtatttaacgttagaccgatcagcggaagcaccgggtacagcggtgttttaaatttcaaatcttctatcttcccgccttcgcggatatatttgcgtctgaacatgatttgggaaagcgaaatcgtaatccagccgacctgtgcgctcatacccgccaaagataacagtaccatatagacagtttcagcctgcgcaaactttgtcagaagtgataggcaggccacagccatcgttacgattaacgagtacatcggtacaccgcgctgatttgtttttccgagcgctttgaaggcctgtccttcattggccattgcgtacagaatacgcgttgatgcgtataaacctgagttcgcaacagataacagtgcgattaaaataacaaagttcatgatatcagctgcatatgggattccgatttgctcaaatacggcaacaaatggactttccacgacacccgcctgtttccacggaatcatgccggcaatgacaatgattgaaagcacaaagaagacaagcgttctccatactgtctgtttgattgaccgtggaatcgttttttcagggtcttcactttctccggctgcaaccccgatcagctcagtcccctgaaacgcaaagttcacagtaatcatcgtaatcagcattgcctttatgccgttcggaaataacccgtcttcataaaaatgtgtcaaaaacggcgcctgctctccgcccttcagatcaatcaggccaaacatggcagctccgccgagaataataaataaaaggataatcaaaattttaatgcctgaaaaccagaattctgattctgcaaaggcttttgtggtgattgcatttaaaataaacatcagtgccgcaaagaccagacaccaaatccacacgtctatatgcggaaaccagcgttgcatcagctgccccgctgataaaaattcaatggcgcatgtaaccgcccagccgagccagtacagccagccgaacgcaaacccgaaggccgggctgataaattttgtcgcataggtctggaaggatcccgacacaggaaaggcgactgccagctctcctaagcagagcatcgtcaaaaacatgataaagccgcccactaaataggacagaaccgcgccgagcggtcccgcttggttaatggtaaacccggttccaaggaagaaaccggttccgatcactccgcccaatgaaatcatgaacaagtggcgcgatttcattgtccgctggagctgatttccgttatcttggtttgtattcacattctgcaccccttcagcaacttgtattggatctaagctggaacatctgcatggtgctatcccagtttgctgtccaaagagcctctatctatttaatataaaattcacttcttctcataaagatacattatactaaaatactgtagctgagcaaatagggagtgctgatttttctgttgtaaatttatacaaacgaagtgaatatcccgccatggtgcggatttatgcgttttgcagcacgtgcttaattttctctatcgcccaatccaaatcctctttggaaatgattaatggcggtgcaaaacgaatgactgtatcatgcgtttccttgcataaaagcccttcttccttcaaacgctcacaatacggacgtgccgcttcagtcaattccacaccgataaacagccctctgccgcgaacttctttaataaccgggttgtcaatgctctcaagctcgcttttaaagtattcgccaagctcaagagaacgatccgccagcttttcatcctccagcacttctaatgaagcgatagacactgcacatgcaagcgggtttccgccaaatgttgagccgtgtgagccagggttaaacacgcctaggatctcgcggtccgccgcaatgcatgagatcgggaacacaccgccgccaagcgctttgcccaagatatacatatccggaacaatgccgtcccagtcacaggcaaatgtcttgcctgtacgtccgagacccgtttgaatttcatccgcaataaacaagacattctcttccttacaaatcgccgccgcttcctgtaaaaatccttccggcggaatcacaatgcccgcttcgccttgaatcggttcaaacaagaatgccgctgtattcggcgtaatggcctgtcgaagcgcttccacatcgccgtaaggaatgagtttgattcccggaagcatcgggccgaatcctcgtttatattcctcttcagaagagagagataccgccagcatcgtgcggccgtggaagttcccgacacatgcgataatttccgcttgattgtcagctacgcccttcacttcatacgcccagcgtctcgccgctttcaccgcagattcaaccgcttcggctcctgtattcatcggcagaatcatctctttgcctgtcagtttggctgttttttcgtaaaacggcccaagctgatcgttatgaaacgcgcgtgacgtgagggtgattttatcagcctgatcctttaatgcctgaatgattttcgggtgtctgtgcccctggtttaccgcagaataagcactcagcatatccatatattcattgccttccgggtcctttacccaagcacccagcgcttcagaaataacaatcgggagcggatgataattgttggctccgtaatgagacgtctgatcaataatttctttggatttagataaagctggcatatttgaattcccccttgttttctgtttcaacatgttatcctgctttccctttatataaatgcaagttctgtgccaaatcaagaattcgtgtgttttctacaattttcgaggacaaggtgcaaaaacattctgatatttcgagcaaaaatttcagcaagtgcaaaattcttttgcataccctctccatttttttataaaatagaagcaatattaagaaaactgagggaggttcatacagtggtcaaagacagcgaattcctcacattggtttttcagagcattttagatgaaatcgatgttggcctgcacgtggtagacgagcatggaaacacaatcgtatataacaataaaatgatgcagattgaagatatggagaagcatgacgtcttgaataaaaacctgatggatgtgtttatgttttcaaagcagcaggacagcacactggtacaggctcttcaggaaggaaagacgattaaaaacgtcaaacagagctatttcaataataaaggccaggaaattacgacgatcaatcatacatatcccatcgtccaagacggcaaaatcaggggcgccgttgaaattgccaaggatgtgacaaagcttgaacggctgatcagggagaatatgaacaaaaaaggcagcacaacctatacgtttgacagtattctcggcaccagtccggccattcaagacgtcatcgaaaacgccaagcgggcaacccgtacgtcatcatctgtccttctcgcaggcgaaaccggcacaggaaaagaactgttcgcgcaaagtatccataatggaagcgatcgttctggcggcccgtttatttcgcaaaactgtgcggcattgccagacagccttgtggaaagcattttgtttgggacgaaaaaaggcgcgtttaccggcgctgtcgaccagcccggcctgtttgaacaagcccacggcgggacgctgctgttagatgaaatcaactcgctgaatctcagccttcaggcgaagctgctgcgcgcccttcaagaacggaaaatcaggcgcatcggttcgacaaaggatacaccgattgacgtacgtattattgccacgatgaatgaagacccaattgatgcaattgcaggcgaacgaatgcggaaggacttgtattacaggctgagtgtcgtcacactgatcatcccgccgctacgggagcgaaaagaagacattttgcttctcgcgtcggagttcatccagaaaaacaaccatctgttccaaatgaatgttgaacacatcagcgatgacgtgaagcaatttttcctttcttatgactggccgggaaatattcgcgagcttgagcatatgatcgaaggcgcaatgaatttcatgacggacgagcaaacgattacggcttcccatctgccctatcaataccgaatgaaaatcaagccggctgacattccagagcctgaaacaccaagacaccagccggccgcggacttaaaagaaaaaatggaaagcttcgaaaaatatgtgatagagaatgtgttaagaaaacacggccataacatctcgaaagctgctcaggagcttggcatcagcagacaaagcctccaatatcggctgaagaaattttctcactcgtctaacgaataatccggagcaggaagcctgatcagaaaaacagtgcctctgccgatttcacttttcacttcaatcgtcccattgtgattgtcgataatcgatttcgttatggcaaggcctaatcccgaacctccatatttccgggagcgggatgggtctgccctgtaaaatcggttaaataaatgcggcaaatgctccggcgcgatgcctgtgccattgtctgctatcatcagcatcacgccggaactgcctttttgcagagaaatagtgatggcaccggttctctcatttgtatactgcaccgcgttataaaccaaattcagaatgacctgtttcatcttatcccggtcaaacaccgctttagcatcatcctcaagcagcagctgcagccttctttcttttgcaagcagactgagctgcggctccatttcccttatgagcgcatcgagatttcctctcttcatttcaaagctcggcacccgatcaatttttgctaaaaacaacagatcctctatcagccgagtggctctcttcgactcttcatacatactattcagcgccctatctctctgctccggctgaagcgcggcgccacgcagcagcacttcgataaagccgtgtatggacgttaaaggcgttctcaattcatgtgaagcgtctgatacaaattgccggatgcgctccttcgcctctttttctgctttaaatgacgtttcaatccgctccagcatgcgattaaacgaaatagcgagcgtgtcgatttccatttgttttcgatatacaggaagccttttattcaaatttcctgcattgatttctcccatcatatgtaccatttgtgataacggtttaagcgtatgtctgaccacaggcaagaacgtgaaaagcccgagcaggagcgcaaccagcgagagcgtggaataaatgctgatttgccggagcagtacgtccttcagtggttctgttaaagtactcatttggatcacgcctgcttcttttccatcaatagtaatagcctgaaacacaatcagcacttcctcgccggattcatttttcgtgattttgtaatgcaaggccatcgtatcttttaatgcctcatcatatacactttttttcactgttggcggtgctcccgcatatggatcggtcgacaataccgtactgtcttttgttttcttatcgataaaaacaatggtcacgcccggatagataaaggcgggacggacagcaccatctgacttttccgagctgtcgggatggcttttgtatgttttaatattattccagatggttggctccgttgagttgatataactttgaatgctgacagctcggttttcatataagaggcgttttccaaacacatattgcatagcgccgacaaacaccaatagaagaacgagaatgcataatgaacggaataaaagctgaaagcgcagtgttttgaatcgttttttcattcaatatccacccgatagcccgcaccccgaaccgttcggatcacttcatgctttttgtcattcaatttttcccgcaaggaacgaatgtacacttcaacaatattctcttctccgtaaaaatcatacccccatactttatccagaatccttgctttactgagcacaaggccgtgattcagcaccaaaaactttaaaagctcgtattctgttgctgaaagcttgagcacctcttcctgatagcggatttctctgcgccgatcatcaattcgaaacggaccgagcgcgaattcttcaaacaggttgggaaagtgatcccgaattctcgcatagattcgcgccagcagctcttcaaagctgaagggtttgatcatataatcatcagcgccctctgtcagcgcttttacccgaacccccacctcatccttggccgtaagcataataaccgcggtatggccggtttttttcatcatcctcgatacttccagtccatccattccgggcatcatcacatccaagatggccacatgcggctgaaatgtctttacggtgttcatcgctgtcattccgtcagctgctgtcttcacttcaaagccttcattttcaagacccattgtcaaaaaatctaatatcgccggttcatcgtccacgagcaaaatcttgatgcctttcatcctattcatgctgtgctctctccttagttggcataaacctctgattagttttttcccttcccctcctattattcgtttttacctgaaaacaaactgaatcttccctaaaaatcagctgaattcagcaagttttcagccagccctcatttgattttcagcttcggcctatacaattgccttagttggtacagccaacaatgaaataaaggaggaatctcacatgaatatcactaaagttttatcaggagctgcactgggaacgattatttcaatcagttctttcacttctgctcacgccgctgtcattcaaaaggatgatacatcaacgaaggttgagacgaagcaacaggcttccatcacaatagcaaaggcaaaacaggttgctttgaacaaatgcaaaggtactgttcaatcagcccaaatgaagaaagtgaatggcacatacgtatatgttgtgaaagttctcggtgaggacgacaaacagcatacgatgaacgtcaactgcaacagcggcaaagttgtgaaacatgatgttcaaaagaaacaaagctatatcagcaaaacaaaagcccaatcgatcgctttgaaaaactgcaaaggtgcggttcaatcttctgagctgaagcaagaaaacggtgtttacgtttacgtcgtaaaagtaatgggtgaagacggaagccttcacacgttccatatcaatggagaaaacagcaaagtcgcaaaacacgagcaaaagaagcaagcacatctttctaaaacaaaagcgcatcaaatcgcactcaacaaatgcaaaggcgcagttcaatcttctgaactgaagaaagaaaacggcgcatacatctacgttgtcaaagtgcttggcgaagatggaagcactcatataatccatgtcaactgtgacagtggtaaaatcgtaaaacaagaagtgcaaaagaaaaacgcagccgttacaaaaacaaaagcacatcaaattgcactaaataaatgcaaaggcacagtgaaatctactgatttgaagaaagaaaacggcacattcgtttacgtgattaaaatcactgcccaaaaccacactgaacaaacagtgaaagtgaatgctgaaaacggaagcatttgcaaataaaataaactgcctgccagcagtaaaataactgaaattcaacgtataacaccagtcttgttttaacacaaagttctaagttcatgtctacctttttctaaatactcttttaaactgaacgtgcgtgacccgcgttcagttctttttctaaggaggacctacaaatgaatatgaaaatatgttctgcagctgctttaggagcgatcatttcaatcagttctttatcatccgcacacgcggctgttctgcataaagaagacactgctaaagttcaaacccagcagcaggcttctattacgctctctaaagcaaaaactgtcgctttaaagaactgcaaaggcgcagttcaatcagcacaaatgaagaaagcagatggcgtttatgtctatgtcattaaagtgcttggtgaggatggcaaaattcacacctttaacattaaccgcaacagcggaaaaatcgtcaagcatcacgttgaacataaacaagccgcgatcacaaaagcaaaagcacaaagcattgcgttgaacaaatgcaaaggtactgtcacatcttctgcattaaagaaagaaaatggcacctatgtgtacatcatcaccatcacagccagcaaccacacggtacaaaccattaaagtgaatgctgagaatggaggtatttgcagttaacagccatttgctgctgtttcacgtgtaacatccatcttgtatttttcttcatattcgatatatccttttcaactgaacgggcgtgacccccgttcagtttttttgcatatcaaaacagcctggcaaacgatgccagactgttttgattaacttcctaattggtctgcggaggacagcttgatgtctacagatttttcttttccgccgcggtaaaacttcaccttcacccggtcaccgacttttttctgataaagccgttttcgcaggtcaacaatatcatttactttgtatccgtcaaatcccgtgatgacatccagttccttcagccccgcttttccggcaggtgaaaaggcgtctacacccatcacaaccgctccattggtaacatgcttaggaagctttaatgtttcatcccaatgatagcttgcgatgtcgcttagcgatttcatctcaatcccaaggaacgggcgtttgacctttccgtatctctctaaatcctctatcacagggatcacgagcttagatggaatcgacaggccaatcccttcaaccgccgactcggcaattttcattgaattgatgccaatgaccttcccatccatatttaacaaagcaccgccgctgttcccagggttaatggccgcatctgtttgcaggacttctgcgttccagtcaggctgtccatcaccgtttgaatctactgggatcgccctctccgtacccgagatgacgccttgtgtgacagagccagcaaactcaaggcctaacgggttcccgatcgcaataaccggctccccagacttcactttatctgaatttccgaaatcggcgactgctttaattttatcgcttttcacccgtaaaacggccagatccatcagctggtcgctgccgacaagatcagctgatacacgtgagccgtctttcaagctgatttcaatttgggaagcgccttcgatgacatgatggttggtcacgacataagcggaatggtcatttttcttatagatgacgccagagccgctcccagcctcgccgctctctccccgtatatctgatttttggatgttcacaacaccgacaacggcgggcgacacattgctgacaatcttggtgaccgtattgttgacactgacattcaccgtcctgattgattcccggccgttattgttctgctgctgatctaaagcgcccgtatctagcccttcatttgaaaggtacggcatgataaacgccattaatacggcaccgacaatcacgccaatcaggcttgaaagaaaatatccttttttgcttctctttggctgttcaggagtagtatgttcttcctcacgttcgtaatccaccatattccatcctttccaagaacgttaatatggttatattgtgggttagaagctcctagaatagtcatgatttacatagaaaaattatacagcgcaaagcggagtggccttcttcggatcagtgtcgtataagtcaaatgtctcacccgtcacaaatcctttagaagccaatgtctgctgcacggacattcttgccagctccttcatgttgttgtcctggctcaaatgcgccaggtaaatacgagacgtctcatcgccaatgacatccgtcatcgccaaggcagcatcttcatttgaaacgtgcccgacgtcacttaaaatccgccgcttaatgctccatgggtatcttcccatttgcagcataccgacatcgtgattgctttcaaacacaaacacattcgctgaacggataatgcctttcattcggtcgctgacatatcccgtatctgtcattaacgcgagctttcggccgttataatggaacacataaaacatcggttccgccgcatcgtgggagacgccaaacgattcaacatcaagtccgccgaacgacttcaccgtctccatcggaaatacaaacttttgatcggtgtcaattttgccgatttgattctccatcgctttccaagtcttctcattcgcatagatcggaagcttgtactttctggcgacgacaccaaggcccttaatatggtcactatgctcatgcgtcacaaaaatgccgtctacatcatccagcttacgcccgatctgcgccatcagcccatccatggcttttccgctcaaaccggcgtccactaaaaatgcgtgatcctctgtttcgaggtaaaacgcatttcccgtactcccgctcgcaagtacgctaaattgcaagctcatgtttgtctcactccattattttcattgatctgtatctaaaatcgtactctccaaagcattcacagtaaaatactcttgtactgtctttttctcaccgttcacttttttctcgtactcgaccgtaattctccataccggcgccagcacctgcgtacttgtcagtggatattgtgctacatagccgaatttacagctcttcacagtgctgtattcttttaattgattttgatagtacaatagctcaaccgcatccatttcagtaattaagctttctttctggatttgcttgaaggtctcaagcgttgtctggtcgtacgacacaacctcgtttttaccgtttaagtgcaataccacttgcccgatcatattagcgggattatcggtcttttggtaaatataatggccttcgtacgtttggaagaaaataatttctttcttcgatttattaaccttccaaagcttatatttttcgccatcttgaatctttgaagaaacaagtgcctgagcatcgtcctcgatatccttctttgatagggctattggatttgcaaacttcattttcaggctcgttactttatgatcatcactaggcatgtccatcaaaggcttttgatccttcagcgcctcaatttcctccttggtgaaggctttttgatttgccgtgatccgatagccttctgtcgcttccttattcaagccttcatacgtgatatgatcggccttcatgtcatgctcgacatcatttttaatgacttcatattctttgccggtagcctgccatttttgaaaaaactgatagcctaagaaaatatctaaaatgaggaaggcaacgatgaagattgattttgtcttattccactccactgttagccccctccttcctcaataaatcctttgtaatcggcacaatttttccatttactttcatcgcccaaaccggttccagttcaacgagaggatcatcgttggttgatgttgataccaattgataagcaaggaagatctgatcaattttgtccgtatcataagcggtttgtttcgaaagcagcatcctcacttcgctgccgctcatgagctctgtttcacttgttttaatcggattcgttccgagactgtaattcggccgcttatagctgagaatatcatcattcgcccattgcaccgtaatcgccgatgtcgccccgaaaggtttggtggtgctgttaatgaccgggatctgatccataaagatatagaaactcagctgctggctgtcattgatactgaaaaattgatagtgatccgtccagcttccggtatcctcaaggtatttttggctctttttgattaattcacctgtttgataggatgtgctctgcaccaaattgcgctgttgaaattgcacctgtcgctggcttagattcacatctaaacggctgatcccatctgtcagcacatttctgttgttgtaattcgaatcttctcttacaatgctcggatcactaaacaaagcctgcttaaaggtatttgttttaatcgattctgtgacaaattcttttttgtccatcgtaagcggtttgttcggcagcaagaactctttctttgagccaatggagaacaaactgaacgccggcatatttgattgcctgtttttcaagtcgttcataatgttccggtagtttgctgactcaaccgtcacttcaagaatgagctgtttgctgtaagacaccaaatagattttcttgttcgcttttgtttcattgaacgggatcagaatatggtcaaacgaactgtattcaaacgactgattagaccatttaaacagcgtttggaaaatatcaatcggaatcgtatcgctgaattgcaagtcaagcttggcttcagaaccgcctattccataaaaccagcttttgaatccagccttgtcatactgatccgaaatatctttaattcctttcacatcccaatgtggcaagtcagaccaaatttcttcatagagggcattgtcatccactttgtaatgagcgccgtcatcatggataaacatgtcccttggccttaccgtttcagacagcttttgagtggttttttcgattttatgtttcacacgaacagtagactctgttgaggatgagccttcagaaaagtttggctggaacgtccatatcccccatgtaaaaacaagactgatgacgacgagtaccgtaagtaatatcgtttttatattttcacgcttcatcccaatcatcctcttgttcctctttatatggaagagtaaatgtaatcgtcgtgccttttccttctatgctgtccgcccaaatatctccgccgtgcgcctgtaccatttccttggcaatcgccaatcccagaccggtgccgccaagttttctcgttctcgctttatccaccctgtagaagcggtcaaagactttttcgacatcttttttcggaatgccgatcccttcatccttcacgctgatatagagaagttcttcctcttcattgacatcaatcgagaacgtgacatgtccgccttccggtgaatattttaaagcgttagaaataatattatcgagcacctgcgtaattttatcctggtcgatctcgacgtacagatctctgtccggcagattgcggataaactccacatgctgctcttttgtcatttcaaaacggtcaataataagcgacataaaccggacaatctgaatccattcccggttaaattgataatccttactgtcaaatttcgacagctgaagcagatcattgacaagccggatcatacgctctgtttcattttgtgtcaccattaagaagcgcggagcaatgtctttattttcccacgcgccttcagctaacgcttctaaatagctgcgcattgtcgtaagcggcgtccgcagctcatgtgatacattcgcaacgaattctctgcgttcctgatccattttctcttgttcggttacatcgtaaatgacagcgattaaaccatcaattttgccgtgttccctttgaatcacagagaaattcacgcgaagcaccgttaattcatcatcgcgctcaatttcaagcagcatagaatcctgctgctccactaaatcttcaaaagtataattctcttgaagccccagcaaactcgtaatcggcatttctaaggctgtttcacgtgaaacgttcaacagctccagcgccgggctgtttaagagaataatcgctccatttcggtttgtagcgattacgccgtctgtcatataggcaatgacagaggctagctttctgcgttctccttcagtcatcgcctgggcatcttcaagctctctcgttaagtggttaaacgttgtggccagctgcccaatttcatcatgcccgtactttttaaccttcctcgagaaattccctttcgcaagctccatcgcctgctttcgcatatctgaaagcggatgggtaatggttcttgccagaaaaataccgagaagagccgtcaaaacaagtgccaaacctgtgccggacgccaatatcgtgttgatcgtcttcatttgattaaagacatcttccatactcgcgacaacatagatcgcgccgacaacctcttggttttcagtcatgacgggcttcgcggaaataagaactctgattttgcttttcgggtcataatattttcttaaatacgactgtttggtagaaaaaattcttttgaaaatcagatcggtcgtttgtttccctgccacttcctcaccatacggctttgaagaaccgaccacttcatagcttttatctacaaagctaatttcccgaacctcatcacttttcgtgaagtcattcaaaatacggctgacgtcatcctttatgacggtgctgtcgttatcgctcttatattcttgttcgatataataagaaaggttgtcgattcgctgattcagcgattgttcataagagctgatcagcgacttctctacctgattgacaaaatacacaccaatgatttgcatggcaatgataatcaaaagtacataaatcaaggtaatcttaaattggatcgaccgaaaaaaaccaaccttattcatatggtcattagtcctgttctgggtttctcaagtaataacctacaccgcggcgtgtgacgatccaatttggatggctcgggttgtcctcgattttttcacgaagccggcggactgttacgtcaaccgttctgacatcgccgaagtaatcatagccccaaacggtttgaagcaaatgttcacgagtcatcacttgtccgatatgttttgctaaataatgaagcaattcgaactcacgatgagtcaattcgattgtttcgtctcgttttgatacaacgtacgcgtcagggaagatgacgagagagccgatatgaatctcgttagaggaaggctcttcctccgcaggcgctgttgtcagctggcggcgcaggttcgcttttacacgtgccaagagctcgcgtgtgctgaatggttttgtgacatagtcatcagcaccgatttcaagcccgataaccttgtcaatttctgaatccttagccgtcagcataatgattggcatatcgtatttctttctgacttcacggcatacttcaacgccgtctttattcgggagcataatatctaaaagaattaaatcaggctgaagctcttctaccatttcaacggcttcgtttccgtcgtgggcacagtgcacttcatagccttcttttcttaagttaaattccaatatatctgcaatcggtttttcatcatctactacaaggatctttttatccatcattttgattttcctcctgccgaatgacttcatttcatctatataacattcgtttcatcacttatggcccatgtaaagaatgggtccttgtctattataacggtttaaggtcaaaagataaaaaaaataaaggtttagaaaaaaaacacatgtttcacctttatcgccagttgtttatctattgtcatgctggtcaactttttttaaaaaagataactttattgaaacctcccttcaccggagtgcgtctttatcaatgacgtcttcttctttgaaccggccgcagggccggttctccctttttcttctattataacactcctcatgtttgcctttttcctaaaagaaaaaacgcacctacgattgcagatgcgtttggtaagtggctcgggacggaatcgaaccgccgacacacggattttcagtccgttgctctaccaactgagctaccgagccaaatgttttatttttctctactaagtaaagtaaaatggcggtccggacgggactcgaacccgcgacctcctgcgtgacaggcaggcattctaaccaactgaactaccggaccttacagtaattgcccggagagctgtcgtgtcagctctcacagacaaataaggaatttagcaataacgctaaagtaaatcaatgacccgtacgggattcgaacccgtgttaccgccgtgaaagggcggtgtcttaaccgcttgaccaacgggccttcacgaaatggtgagccatgaaggactcgaaccttcgaccctctgattaaaagtcagatgctctaccaactgagctaatggctcttaaagatgtcggaatttctatagagcaaacgacttagatctagttctcatcttgtactctattgaagcagtttccgtaacaacgagatttataatatcacgaacaaatagaagtggcaataacttttttggttttttttcatatttttttctcagaccaacttatatgcagctttcaaacaaaaaacaagccccttatataggggcttgcagacatattctatttagttcgcacggtacacactgcgaaggacatttgtttgtgagcggtctggaccgacagagaaaatagaaagcggaatgcctgtcagctgagacacacgctcaagataatggcgcgcattctccggaagctcgctcaagctcttcgcacctgtaatatcctcagtccagcccggcatttcttcatataccggctcacattcagcaagtgccttaagacttgctgggaattcttcaatgatttcgcctttatagcggtacgccacacagattttcaacgtttcaattcctgttaggacgtcaattgagttcagagaaagatctgtaattccactcacacggcgggcgtggcggacaacaacgctgtcaaaccagccgacacggcgcgggcggcctgttgttgttccatattcgcgtccgacttcacggatttgatcgccgatttcatctttcagctcagtcgggaaaggaccgtcgccgacacgagtcgtatatgcttttgatacaccgacaacgtgcttgattttggtcgggccgacaccagaaccgatcgtgacaccgccggcaaccgggttagatgacgtaacaaacgggtatgttccttggtcgatatcgagcataaccccttgtgcgccttcaaataatacacggcgcccttcatcaagagcatcgtttaagacaacagatgtatcgcaaacatactttttaatctgctgtccgtactcataatattcgtctaagatatcctcaagtttaaacccttctgtctcgtacattttctcgagaagacggtttttttcttcaagattgcgctcaagcttttccgcaaacgcgtcacggtctaacagatccgcgatgcgaattccgatgcgggctgctttatccatgtaagcagggccgattccttttttcgttgtgccgatcttgttagcccctttacgctcttcttccacttcatccaatttcaaatgatacggcaaaatgacgtgagctctgttgctgattctcaggttatctgtactcacgttgcgctcatgaagatacgcaagctctgtgactaatgctttcggatctacaaccattccgtttccgattacacacgttttatccttatagaaaattccagacgggattaagtgaagcttatatgtgattccgtcaaacttgattgtatgccctgcgttatttccgccttgataacgggcgatcacttctgcattttctgataggaaatctgtaattttaccttttccttcatcgccccattgcgtacctactacaactactgaagacatgtccgtgcacctccgttaacctttcaaaacgattctattcaaacaaatcaagtttatcagtgaagaaacagaaagtcaattgtaaatccgaacattaaattattgtaaatctatattcgttcgctttcattcgttttataagcgttttctcacggttttgtcataaaaagcttgcgaaactttcatcctttagcataagaaagaatcacttgcctgatatcccttttgaattcataaaaacgacccgccagccgtccgggtcctctatcgtcactcccccattgctccagtacgggttctctgattcgacctcttgatagcccatgtgctttagctttgaagtgatcgctgccagttcatctgcattcggcacataaaaaacaagaaggctgtcgggatggggaacgggggcagtgcttccaccttcatactgggtgaattccaaatgataatcggcatgaggaaggccgaacatgacaccgtcatacccgttatgctgtgaaaattctcctattcgtttcaaacacagtccctcttcgtaaaaacgaataatctcatcaagctggcccgtaggacgcgcaattcggatttgtgctgcgtgaaaagacgaaaaacgtttttccatattgttaccatctcctttttgcaccattttattaaaacgctttcagattttcatccgctgagcgaacggtatttcttccatctttcgaatgaaaaaaaccccaagagcagctcttggggcttatgcgccgggcggaactcctgcgtcatcaaaacgccgttccaggttgacgaatttgttgtattcttttacgaacgcaagagacacggttcctaccgggccgttacgctgtttggcgataataatttcgataatatttttattctcggtttctttgtcatagtagtcatcacgataaaggaacgcgacaatatccgcgtcctgctcgatacttcctgattcccggatatcagacatcatcggacgtttatcctgacgctgctcaacacccctggaaagctgagaaagcgcgataacagggacttgcagctccctggcaatcgacttcagttcacgggaaatttcagatacttcctgctgacggttgtcctttgaacgaccgcttccctgaatcaattgcaggtaatcgatcaaaatcatgcccagcccgctttcctgcttcaagcggcggcacttggcacggatttcactcactcgaatacccggtgtatcgtcgatgtaaatcccgctgttcgacaggcttcccattgccatcgtcagcttgccccaatcctcttcggtcaggttacctgtacggagattctgggcattgatatttccctcggcacagagcatacgcataacgagctgctctgcacccatctcaagactgaaaattgctacgctctcatcggtctttgtcgccacgttttgtgcgatgttcagggcaaaggctgttttccctactgacggacgggcagccacaatgatcaagtcgttgcgctggaaacccgcagtcatccggtcaagctccgtaaaccctgttggaattcccgtgatatcaccttttcgattgtgaagctgttcgatattatcataggtctggacaaggacgtccttaatattttggaaggcactcgtgtttttgcgctgtgccacttccataatcgttttttccgcttcactgagtaaatcctcgacctcatcctcacgggtatacccgtcttgagcaatcgttgtcgcagttctgattaatcggcgaagaatcgatttttcctcaacgattttcgcgtaatattctatgttagccgctgtcggcaccgagtttgcgatatctgtcaaatatgaaatgccgcctacttcttccagcaggtctgtgttcgcaagctctgatgttactgtcaccagatcaaccggttcacctcggtcaccgagcaccagcatcgcattatagattttttggtgggacattctatagaaatcatctggaatcaatacttctgaagccagtgttaaagcagacggctgtaaaaaaatagcgcctaacacggcttgttcggcttctatattttgcggaggaagccggtcattcagaaggtctgtcatgctaagcaccgtcctctcattaaaaaatctccaacctccattctaccatttctacagaaaaaaaatagaaaaattgtctgtttcctgtttttttcagttagcagattggatcgtttcggacagtaacaaggcgggaaaaatgcaataaaacatgagggaggaatgaaagatgataaagaaatatgcgattacgcctaatgttgatgcggacggctggtttattgaggtggagaatgtagcgccgacagctttgtatacgtctaaagacgccgctattgaaaaggccaaacaggtggctaaggaaaacagtccgtctaagcttgtaatttatgaccagtttaaaaatgtggaagaagaacactcattttaatgaatgaaagccttcgctgcagcgagggttttttagcggttatcggtttatttcatccattggatgcctatgtgcatcatcaaatctgccgctttttgatacagatcccactccccgatcgaagcaaatttccccatcagctcccgaagctttagcctcactgctatatattcttcgaaagtgacagctttttcagtgtctatttggtgttccttcagcatttgttttaataaagacaacggtgcgtgcataagaaccctccttacctcttttataacggtcattttccgattgctctattcctttgtgacatcttcttacatttcacatctgattcttgtacaatggacagaagagaggagggatcttttgtgagacctttgcaaatttctgctgaaactgcacaaaagcttgcagagtccttgaatctgccgcttgaacagatcatgcatatgcctcagcatattctgcttgccaaaatggctgaactgcaaaaagaggacaaatcatagccttcattcacatacttgcttacctgtttcgggataatatcatgtatatgttagaaaagaggagtaactgctttgccacatccacataataaaaaaatccaatcattttggctgatcaccggcattatctttatcgcctttaacttacggcctgcgatcacttcagtcggtccggtcatcagctctatccgggcagagctgcacatgtccaatggggcagccggttttttgaccgcactgccgctgctttcgtttgcagttctttctccgcttgcacctaagcttggacaacgcctcggaaatgagcgaactttatggctaggtctcgtgatactgcttatcggtgttttgactcgttctaccggctatactgccgctttgtttttcggaacggcacttatcggcgtcgggattgcgattggtaacgtacttttgccaagcttaatcaaacataaataccctgaaaagccagggatcatgatcagcctgtatacgacatcaatgaatatattcgcagctttagcatcgggtgtcagcgttcctttagcgacccagatgaatcgcggatggaaacaagcctttctcttatggggcgggctggctttgcttgcattgctgatctggatacctcagctgcgccatcgagatacggcaaaccagacaatgaagctgcaatccagttccatttgggcttccaaaatggcatggtatgtcaccatctttatgggcctgcaatcgtttttattttacagcagcatcgcttggtttcctgaaattctccgttcacacgggattgatacggcaacagccggatggatggtatcactcatgcaatttgcgagtctgccttccacttttctgacgccagttttagctgaccgtgtgaaacagcagcgcggtatcgttgcggcgctggcctcagtttatctgatcggcctctgcggattattagcgggcggaagccatacattgcttgccatctggatgatcattatcggtatcgggcaaggctccagcattagtctggcgctcactttgattggtctccgcagtgaaaatgcccaacaggccgctgcgctgtcaggcatgtctcagtcattcggctacctgctggcagcagtcgggccaatctttgtcggctatctctttgaccagacgcattcttggacgatgccgattgtgcttctcattgctgccctgatcgtaatgggagcagccggacagggagccggacgagatcgatacatttttcagtctgaaaaaaaaagaaattcagcataaaagcggggaaaatatctccgcttttttctttgaatatttatggtttattcataagtttttcatatttgttttttacaattagacaccataaagaggtgaaaaacgatgaaaaccaaacgattcgacgcagcccttatttttattttgctgggagcagcttttttgaatacgtatcacatttggcaggatgatgcagcgaaccagtactatttggcggctgtaaaaagcatgacgcaaagcttccataatttcttttatgcgtcatttgacccttctggatttgtgacagtagataagcctcctgtcgtgttatggattcaaacgattttcgcactgattttcggtgttcacacgtggagtgtcatcattccccaggctcttgccggagttggatctgtcttccttctctacagaatgattaagccgacttttggagttggagcggcccgcattgccgcacttgtcatggcactgacccctatcgcagtagctgtcagccggacaaacaatattgatagcatgctcgtttttaccatattgctcggttcagcttgcctgtttcgggcagtaaaacaaggcaagctggtttggctgctgatggcatttgccctgattgggctcgcctttaatatgaagatgatgcaagcgtttatggtattgcctgcatttgtgttattctacctggttgcatctcgggtttctctgaagaaaaaaatcgggcccctgcttctgtctcttgtccttctgacaggcctttcactctcatgggcgattgcagtggattcagcctcttcctcaagccggccttatgtaggaagcagccagaccaactcagtgctagaactggcctttggctacaacggcacagagcgtctgcttgggcaaactacgggcctagcaaagggtgatatgaatgctgctggcggagggaacatgcagaatcaagacaacatgcaagcgccaaatggcaacggttcatctttttctcagaacggaaatcaatcattcggaaaccattcacaggcgcctcagccgcctaacggacaaaccggcgctctcaatggaggcggaggcacacctcccacaggtggcaacgggcctggaaatggagggcctggcggcggaaaaagtatgaatatgttcggcaccggtgatcctggcccgcttcgtcttttccaatcagcactttccggccaaatcagctggatgcttccattctcattgatcggattactgggcgcaatcgtcagctggtaccgtgatcgccgcggacatgctgctaaaatgaaagaaacgctattctgggcggcttggcttgttcccgtggctggtttcttcagcatcgcaggattcttccaccagtattatttgattatgctggcaccgccgattgccgccctttctggtatcggatggtatacgatgcaccgcttatacaaaaataataaagactggtccagctatcttctgccggcagccgtcttgatcacagccgtgtttcagatgtatattctgagcgcttatacaagccaaatcggcagtgtatggatgtatgtcctggggctcttaggactgggcatcacccttgcacttctgatgcttaaacgcagccatccgttcagtaagctgctgaccatcatcagcttgtgcgttctgcttctcacaccagtttactggtcagcaacgccgcttctatacggtggtaacagcgtccttcctgaatctggcccgcagctcaaaggctcagcaaacggcgggaacatgttctcttcagaggtcgacagcgggctcctgtcctatctgagaaaacacaataccggcgaagaatacttatttgctactttgacaaccgtaacagctgcgccatacatcatttacgaaaatgaatctgttatggcaatgggcggatttaacggcacggatcccattctgactgtgtcggaactgaaaaaactgatcaaagaaggcaaagtgaaatacttccttctgtcagaaaacaactcaggcaacagcgaacttgtttcctggattaagaaaaacggaaaagaaataacatctgacgagtacagcggttcctccagcagcacgaacagcgtgcagggaatgcgaggaggacctggcggagaaagccagcaaactctttatctcgtggaataaaaaaaagaggcttggatgaatccaagcctcttttctattaagcttcttcttttacatgtacctttaacacagcctgcacttcaggatgcagcttcacaggcacgttcgtatatcctaatgcacgaatcccgtccggcagttcaagcttccgcttatctactttaatgttatggtctttttggagctgttcagtaatttgcttgcttgtcactgaaccaaataaacggccgccctcacctgattttgcgctaagctcaacagtcagtttttctaatgtctctttcaagctcttagcctgctcaagctcggcaatggcttcttttttctctttctgctgttgtccgtttagcgcgctgatgtttgaagcgttcgcttcaaccgcgaggccttttttaattagaaagttatgcgcataaccgtctgctacgtttttgacttcgcctttttttccttttccttttacatcttgtaagaaaataaccttcatctctgtacgcctccctcaaaatactcatctatggcgtgcttcagccgttccagcgcttcagaaactgaaatgccggacaactgagtcgccgcatttgttaaatgccctccgccttccagggcctccatgatgatctgaacatttacctcgccaagcgaccgcgcactgatacaaaccgtttgttcatcccgtctcgccaccgcaaatgaagcctcaacctcactcatcgacagcagtgaatcagcagcctgcgcaatcagcacttgatcgaagtattcctcttcattttcaggaagagaagcaatcgcaatgttatctttatagaggaccgtatgctggatcagcttcgcccgtttaatataggaatcaacggtttctttcaggaacttctgcaccagcaccgtgtcggcgccttttgcccttaaataagaagccgcatcaaaagtccgcgagcccgtgcggagagaaaagctctttgtatccactattataccagctaatagggctgttgcttcaatcatattgatttttaagcgcttcggctgatattcaagcagctctgtcaccaattccgctgtggaagaagcgtatggttccatataaacgagcagcggatctctgataaactcctcacctctgcggtgatggtcgatgaccacgatatgttcaattttattgaccagccgttcctccataacgagtgacggcttatgtgtatcaacgatcacaagcagtgtgtcatcattggaaatttccattgcttcttcaggcgtaataaatcttgaccacagttcttcatattttttgatttccccaatcaaacgctgcacacttgatccgatttgatttgggtcaatcacgataaaaccatctttgttatttgcctgagccacctttaaaatcccgatcgctgcgccgatagaatccatgtcggggaatttatgccccatgataatcacattgctgctttcggtgacgatttcctttaaggcgtgagaaatcacgcgggcccgcacccttgttcgtttctccattgggtttgttttaccgccgtaaaacttcaccttgccgtttggcagcttaatggctacctggtctccgccgcgtcccagtgctaagtccaagctggattgcgccaaatcgccaagttctttcagggaagagactgaagccccgacaccgacgcttaacgtcagcgctacaccgtcaaacgaggttttttcccgcacttcatcaagaatcgaaaacttcgaattttcgagttcagttaagatgtgttcattaagtacagcgataaagcgttctgaagacgtccttttcaagaagatcccgtactcctgcgcccaagcgttcagcaaagatgtcacctggctgttcatcgtgcttctcgtctggtcatccaatccttgtgtcacatcatcatagttatcaaggaaaatatatgccaggacggttctttcgttttcatatagcttttcaatctgaatttgttctgttacatcaaagaaatataacagacgctcatcccgtttgatgacaaccctaaacttgcggtcattcaatgtaaccgtttccgattccacctcttgtttgataagcggcactaccgattcacaagtatcgtaaagtgatctccccactaaagtgctttcattaaagcaagaggaaagaaacggatttgcccattctatataatattggtcattaaaaagcatgattccaatcggcatttccatcaatgcctcttcaccgacttttttcaacctgtaggacaacgtagaaatataagcatcaatctcttgtcgaataagagaatcagcacgcttaataaaaaacaaaataactgccagcagcagcacttcgacggttcctaatatccagttaaaataaaagctgatgaggattgtaataattgacagagcaatcaatgcatagatgggataccgaaacagcggtttttcataaaagcttggcatttctatcactccccaccatgtgagtaaaactcatgttcacttcaccttattccttatatgaaagcccatatctaaaacgcctaaaatgcgaatggctgccatgaagaccggatgcacaaacccaagtatgacagcaatcacagccgcagcctttggatattgtttcttatggcaatagaaaaagataaatgataaaccttggatgaaaatcagaaacccgagtataaactccccatttaaagcgatagagtacagcatttggcctttttctaaaggcaaaaatgaaagcatgacaataatcaaatacagtactacaacactttgcggaaacttcaactctctaaaaggctttagattaggaatatcgggggagaatcgccttaagagcggcttagcgataaggtaactgaggaaagaaaaaataactcctaccatcacaatagctgttggaaaaagatattgaacgatacccaattgttcttccatcagttttaattgcttctcaaactgtccagcattgcccgactgcttcgctacagtttctaccatatcaagagattgccggtattgtgtcatcgcctcatcaatgatattgatacccaaaaactgaatgcttatcacaaaatagaagacaatactaagcatataaataagagcgcccgaaataatggcgtgcccgggctctttccttttgaaaaaatgtcccatggcaatgccggcgcaagctgacataaaagctacaataagcccgttaaaggacccgacaataaaaacaaccggaagactgacagcgcccatccatatccctagcttcaatccatgtctgatcgtatacaagatcattggcagcggcagtgcaaataacagaattgttccaatcacaggaacataaacgaccagaagcgtgatgatcgcaaacagactgattaaaatagcaccttccattaaagctctcgtttgtttcacttagtcacctcgtatcatcctgaacatacgaatagaaaagagcagcataaacgactgctctttttcatcgctgcaacatacgttgcaccgaatgtttttatatcatctctaaattttacttttatattttaacataagtccaaatcgcaagtaaaatgacgctaatgtttcatgtgaaacataaaaaatgaaaagacattctttgaaaagaatgcccatcacaattaatgtttatcatccataaagccagaagattccttgtttttctttttcgtttttctgacatacataaaaattaagatcaccagtaaaagggttgttgcttgcagaacgccgctgctaaacaagaaaaagttctttatcatgtcccacattgtgtttcacctctttgtgcatgttctcaacccgtatcctatataaggtgaatttccctttttataaacttcaaaacatcatgaacaacattgagcgttgggcatatgctgatatggaatctgatcgataaaggagaattttcacatggatgaacgcagaacattggcttggcatgaaacattagaaatgcacgagctggttgcttttcaatcaaacggactcattaaactgaagaaaatgataagagaagtaaaagaccctcagctcagacagctttataacgtgtctattcagagcgttgagcaaaatttgagagagcttcttccgttctttccacaggctccgcacagagaagatgaggaagaagaacgcgcagataacccattttacagcggtgacctgctcggttttgccaaaacatctgtccgcagctatgccatcgcaattacagaaacagcaacacctcaattaagaaacgtactggtcaaacagctgaatgctgccatccagctgcacgcccaagtttatcgatacatgtatcagcatggatattatccgtcttacaacctttctgaactgttgaaaaacgatgtcagaaacgccaacagagccatttcaatgaaataaaacaagcagcaaaggagttccctttgctgctatttctgctgatccttcactaagccgttcgaacgataagattccagcacgtctctgttggattctccccattctttcatttgcaaaacaatcggttcaagcgttcgcccgaattctgtcagagagtactcaaccttgggcggcacctgttgataaacctcacgatgcacgatgccgtccgcttccagctccctcagctgaagagtaagcattctttgagtaatactcgggcagattcgccgaaactcattaaatcgtttcttgccatctatcatgtgataaaaaagaattcctttccactttccgccaatgacatctagagtaaattcaactggacagccttctttgttcgggtatatattcttttttccactcattcttgaccctccaatagtaccttttttgatactacattacattttgcaactaagctacccagtattttacacaccttttctccttagctcaaagaaaatgcttcttattcacatcaatttttaagggtttgcatgattacacctgcagcaagacgtgttaaactatataaagattacactacttaaaaaaaggataggagctatcatggaaaagatacttattttcggacaccaaaacccagacacagatacgatttgttctgcgattgcttatgctgatttgaaaaacaaactcggcttcaatgctgagcctgtccgtctcggacaagtcaacggcgaaacacaatacgcgcttgactatttcaaacaagaaagcccgcgtcttgttgaaacagctgcaaacgaagtaaacggcgttatcctggttgaccataacgaacgccagcaaagcatcaaagacattgaagaggttcaggttttagaggttatcgaccatcaccgcatcgctaactttgaaacagctgagccgctttactatcgtgctgagcctgtaggctgtacggctaccatcttaaacaaaatgtacaaagagaataacgtgaaaatcgagaaagaaattgccggccttatgctgtctgcgatcatttctgattccctgttatttaaatctccaacttgcacagaccaagacgtagcggcagcaaaagagcttgcggagatcgctggcgtagatgctgaagaatacggcttgaacatgctgaaagcaggcgctgatctaagcaaaaaaacagtggaagagctcatttctcttgatgcgaaagaatttacactcggcagcaagaaagtcgaaatcgcacaagtaaacacagtggacattgaagatgtgaaaaaacgccaagctgaattagaagctgtgatctcaaaagttgtggctgagaagaatcttgatctgttccttctcgttatcacagatatcttagaaaatgattcacttgctcttgcaatcggtaacgaagcagcgaaagtggaaaaagcgttcaacgttactttagaaaacaacacagccctcttaaaaggtgttgtttcccgtaaaaaacaagtcgttcctgtcttaacagacgcaatggctgaataagcaaaaagcatcccgcatcgggatgctttttcttattcacccagcttctcaatttgtcccatcacatcagtaatttgctttgcgttttggaccaggtctgactgctccaattctttaagcgataccttgccttcctcggcttgtttcaacacctcttcagcgcttttctgcaaggtttcgttatgctcctgaatggttcgatgaatctccgctgcggcatcaggcggcgttaattcattaaaatcagcggcatccttctgaatcgattcaagctgcgcttcaagtttttctttcgcctcggtgtcatttacagctttctcagccaattcaggcgcttcctctgcaaatgtcttcaccttctccacataccccgctgcttcactcgtatagttcaatccgtcgttcacctgatcaagcatgccgcatccgcctgcactcaaaagtcccactccggcaagtactgtcaaaatgatcttcatcttcagccccctcatcgtttctttttcattttttcttttaagatcggaatcaatttctctttcgctaacggcagccctttcctcaccaattcacgcttcagccactttttcagcttagacattctgatgctcctctccctttttgataaaaatgaaaaaactccaccaatttggtgaagttcctgaaacaaaaagaccttcaccaaatcagatttggcaaaggtctcgctaacaaatgagattgccagcaaagccgaggacaacttgtcccgtaatgacgactttactgtgaaagctactcccctttggagtgttcatttttattactttcattctaaagcaccgatctgttccagtcaaattcctgccgtttatataaaagcgcgctgtggtatttaaaatttgaatggtttttccatcaggagatcatgctatgacagaggaggttttcatcatgagtcaagagcgcgtgaaacggcctgggcataccagatggtacatatcttcgttacttagcggcattattattcttaattattttgaccgagtggccatctcggtagcggcccctgcgatacaagattcgtttcaccttactgcaactgaactcggcatcgtgttttccatttacacctattcctatacactgatgcagctgcctgtcggaagtttgctggaccgttttggggtcgcatgggtcacgagggttggaatgacaatatggagctttttaacgatccttcttgcttttttgcaaggaaaattgctgttgtatctgttccggtttctcattgggctgacgagcgcctctgcgttccctgctgcctctaaagcaaccgctctctggtttcctccaagtgagcggggattggcaaactcactgttcgattcggccgccaagttttcaaatgtaatcggcgcgccattggtcgcctttcttgtcacaacatttgactggcgtgtcgcttttttgacgattggatgcatcaatgtgctgtttacgatctttttctggcagtattatgaacagcctgaacggcacaaacgtatttctaaaagtgaactaaactatattcaaaaacacaatgccattacaacagagcaaatcccttacaaaacgggcccgcttttaaaaaagcttttcaccaatcggaaagtatggggcttaatgatcggatttacagggtacgggtatacattcaacctgctgctcacctggcttccgactttctttaaacatacatacggtatggatctcatgtcgtccggtttatttacggcagtgccgtggctgatctcaaccatttccggaattgccgtcggcggctggctcgtcgattattttattaagaaaggctatcctaacaccaaggtgtaccgaaccgtaatcatagtcggaatgagctttggctttttctttttaggctccattctgacgaacaatattaccgtagccattatttgcatttccatcggactcgccggaatttcagcaaccgctccggtcggctggtccatctccgcagaactcgcgccgatcggttccgtatccatgctgagctccatggtgaatctcgcaaacaacctgttcggaggcattattgctgcgtcactgacagggtatttgtttgatgtgacaggctcctttacactcagctttctggtagctggttttgtgctgttgctgggattggttttttatgtgtttgtattaggggatgtaaaacgaattaaactggaatgaagagtgcttgctgaaaagcactcttttctttgaatccgccaggtgttattttctttctcccaacattcactaggctgtcttcggacgaaaacaccaccattttatccttgactccaaccaaaggtaaggcctcatagtgaaagaagaaaggaggagtcagatggtgaaattaacagtaaaagaactatccaatattgcgaatgtcacaatcaaaacgctttatcattaccacaaaatcggcttgctagccccaaaggaaataagcgaagccggatatcggtactatggtgctgaagaactaaaaagactgcaggaaatccttttttacaaagaattagatattcctttgtcagaaatcaaaacattactaaaagaggatgctgaaagaacaagtacattagaaaaacaaaaaaagctgtttgaaaagaaaattgaaaagtatcagcgtctcattcaaacagtcaacacatctttagaatacacgagaaaaggcgaaaacatggatcataaggtaatgtttaaaggatttgaaagcgctgaagaatggaaacaatctttagcagaacaaaatgggtatttaaaagagcgttacgattttgaattggatacacatacaatcaatgtcgatgaaatgaacaaaatggcaatagaggctaaacattttcttgataggatggctgattttttaagaaacggtgtaacgtatcatgacccttccgtgcaagagcatgtcatgaatcatcttaagttcctaaatcagaacgggcatccgacaagtaaagaagattacgtaaaacaaacacgtttttttatgcaagatgatttccatagaggaatgttagaagagcagcaaaccggtttatcttattatttggttgtcgttgcagaacacctgtagtgttttgtcaccctttatagggtgacagccatcaggattacgagacagcaccgccaacaatcgaaacattctgccggtcaacggcaaaacgccgtccgttccattttaatacggtttgaacatatcccaatgagtcggcgttataccttcccgctatccgctggtacgccaataattcgtatacgccgtctctgtcaaaatcaaccggatacaaacccgataaaggattcacccatccttctatcggcatttttaacacaccttggctgttataaatctcattcaaatattccctgcctttgtaagtaaggtcgaggatatacgtttcgttttgctgatgactgatgacgctcgctttatattgattttgatacctcacactgtactttaattcatcattcaatacatctgaattgaaaattcgccggaactgcctgtttagataggcaaacacgtatgcataaatagcaccgccgcttccccctgtatctattaccaccgccacatcctcaatcttgtcgcctgtcatatcccccagaaaaagtgacggattgtatcccatattgttttgaagctgaatctgctgctcctgatgggttctgccatcacagatcaccaatgtgatatttctccataacaggctgccgggcatttgatttccagttagaaagacctcatcaataacgccgtctcccgttacatcgccgcgagtagatgcaatgattgcacgtgaggagacaggctgccgaaatacgtatggatgttgaacaagtcctctgctttcataaaaccaataaggagccattctgatgtcatacacattcaattgtgtcaccttccctaatcagctgaatgaatcattatatgcaggaatggcacatcaaagacatatcttacacaccaattaaatccgtaccataagagttatcgattacacaaagccactcgccttgcgcattcttcttaaatacataggtcgcccttctttccatcgcatactcggagtcctttttatccgaatcaagcagtgtctgagaaaggacgagtaccgtgtcacctgcttctaacaggatcatttccccttgtttcgggacaatatgatgattgaaatagttcacaatcgtaataaacgcttttttgatttcttctttgcctcgcgcgatcatgcccggcttcacgactaaaacggcatcttccgaataataattcatcagtgtatcaaaatcttcattttggattgccaaatcacacgcagagatgatgtctttcaattgctgttccaaatgaattcccccaatcatcatgattggatatattatacatcgctagaccactgaaaccttgaaaacaaaatgaaaagtatccttttttcctatataatcaaatagatatatttaacaaagtacccaagtgaaggggtgaacattattgtctgcggaagtaacgttacatgacaatatacattatgatttaagtgcggattgccagcactgttttggcctgtgctgtgtcgccttgccttatgcgaagtcggcagattttgcttttgataaagacgggggcacgccttgccgcaacttacaatcaaactatcaatgttctatacataaagatctcagagaaaaaggatttcgaggctgctctgcatatgaatgctttggcgccggccaaaaagtatcccaaatcacttatgagggaaaggattggcgaaacagccccgaaacggccaaccagatgtttgacgtttttcctatcatgcagcagctgcacgaaatgctctggtatttacatgaagctctttctatagatatagccaagccgattcatcctgaactgagaaccagtttcgaaaaaatagaaaggctcaccaggctcagcaaagaacgcttgctgacactgcaggtggacgagcatcgagctgaggtcaatgaatggctgttaaaaacgagtgaactggtgcgtgcccaagcccgccatccaaaactcccgaaaaaggtcagccggggaagtgtcctgatcggcgcgaaactgaaagggcttgatctgcgaggagcaaatctaagaggggcgctgctcatagccgccgatctgagatttgccgatttgagaatgacagactttatcggtgcagatatgagagacgctgatctcagcggcgccgacctgaccgggagcatctttctgacacaggcacaggtgaacgccgccaacggcgattcgaaaacaaagctgccgctgtctgtacgaacccctgcccattggaaataaaaaaggacccgctaacggtccttttttactgatcaattcaatcctttttcgttccttttatccggcattttcacacttcttgccaagtatcccgacagccataacgcaaccagcagcatgaaggtgatcataccgacgacgcccagccagtgaaaagcagaccagaatagccctccgactgttccgcaaacacttgaaccggcgtaataaaagaacaaatacagcgatgaagcctgtgctttgttatgaagggctctcctgcccacccaactgctggcaactgaatgtccgccgaaaaaaccgaatgtaaagagggcaatccccagaattttcactgccagcatactgtttatcgtgaataaagcacctgcaatgacgatgaaaatattcatcaccagtatttttggatagccatatcgatcaaccattcttccaatgaaagacgagctgaaaatgcctacaatcatcacaataaatatccagctggcaaatgctttattaagcgaatacggcgggcccaacagcacatacacaatgtaattaaacaaggcaacattgcttccgagcagcaaaaaaccaatgagaaacaaactgaatagttttcggtccttcaagtggccaatcagagacattcccaatttcccgagcttcaattttcttggcgtaaaatgcctggatggcggcaaatttataaaaaatataacactagcaatcaaactaatgacaccaattgatcccatcgccatatgccaattcaagtactcgctcaggagcccggaaacgatccttccgaaaacggcgccgattgcatttccgctgatatacagccccatcgccgacccaagacttccgggttcaatttcttccccgagataagccatcgcaatcgacggaaggcctgcgagcgcaacgccttgaatggttctcaatacgagcagcgtatgaaagtttggactaaaggccgatgccagacagagaaccgatgcggccagcatggaaatacccataatcggcttgcgcccccacacctcggataatgaaccaaagacaagcatgctcacagctaacagcattgtggtaacagataaagaaagactcgccgcagtaggcgttacatgaaattcccgcgtgaattcctccatgagcggctgtacgcaatatagaatcgcaaatgtattgaaacccgcagcgaagaaagcaaacgtaatttttcgaaaaaccggtgtgcctttttgaatgtatgtcatcgggactttatcggtccctcatcatgttgtggagcactgccattcataaacaaccatcctttatttcttccgaattcaaacatcctcgagtctgtttatattactatcttagcaccgttgatatatgttgtataatgcatataaaatatcattttcatgcttatatgtaataaaggagggatgataattggaatgggaacaacttgaatattttcaaacactggcccggatgcagcacgtcacgaaagccgcaaaaagcctctccatcacacagcctgcgctttcacgctctatcgccaggctggaaaatcatttgggcgtcccgctatttgacaggcaaggacgatccatcagcttaaatcaatacggacacatttttttgcggcgggttcaggcgatgatgaaggagtacaccgaaggaaaagaagaaatccaagccttattaaagccagaccaaggcgtagtctctctcggttttttacatacattaggcaccacgctcgtgcccgatctcatcggctcctttcagcaggaataccccaacattgccttccagctgaagcaaaaccactcttattggctgcttgaacgattaaaatccggagatctggacctctgtctcctcgcttcgattaagcctgaaaatccgatccaatggatcaagctgtggagtgaagaactctttgtatttgtgccaaatgatcatccattagccagtcgcgaaagcattaccctgaatgagattgccggggagcgttttattttattgaaaaagggctatgcgcttcggatgacggtcgatgagctgtttgagaaggccgatatacagccgaacattatgtttgaaggagaagaagcagctactgccgcaggttttgtggcagccggactgggcatatctattctcccagacctgaaaggcttagaccaaagcaaaatcaccaaaatccgcgtcagctggccggaatgtcagcgtgtcataggaattgcctggataaaaggcaggtttttatcaccggttgctgagacctttaaacaatatgtgatcagccatttttctgagtagggaggattcaaacatgaatgtcaaaaaaatcacgtcagaacaggatttacatacagcgtttgaaatcagaaaggcagtatttgtagaggaacaaggctgtcccatttcggatgaattcgatgagttcgatacactccacggtgactgccagcacatcctagcttatcatcagaatgtacctgttggcactgcacgtgtccgtatcgttggccacgcggggaaactggaacgaatctgcattctgaagtcttaccgcaaattcggtttgggaaaagtgatcgtcgatgcattagaacgtattgtgaaagaacaaggcatttctgccttcaaactgcacggccagacacaggcggcaggcttttatgaaaagctcggctatcagactgcatcagaagaatttatgctggacggcattccgcatgtactgatgacaaaacaagacgattctgctttatagattgttcacaaatttgtcacttatgagcatgaacagttcattggtatactaatcaccgattatggagagaaggaatgattgtatgccagcaaataaaaaagagggtcttatatttggcgtgatgatgtgttttggaatggtctgcgtcatgtcgatttacaatgccatcatcaacggagccattcaggatttttcactggtgaccgtttttgaaatggccatcggttttatggtcgccctcctgttcgatttactgttagtgggccccctcgccaagaagattgcattccgcatgccgttcgacaagactaaaaaaatttatgtcatccttgccatgtcaacttgtatggtgattggcatggtactttgtatgtctgtgttcggtttagtgacagcggttctggcaaatgggctgaacggggacagcctcttcagtgcttaccttatgatggtgttgaaaaatttcatcctggcctatccattgcaattactgattatgggcccattagtcagagggattttcatgaaatttgtaaaaccaaagctcaaaactgcaatttaaatagaaaaggagtgagcctgacactcactccttttgctcatgaatcgaatgtaaaacaagctccgcaaaagcctctgcggcaggcagctgccattttttctttttgagtaaatcggatcaaggactgcaccatgctgaagaactttcagcttatgtttttcacttccattaatccctataccttaccaaatagtttttatacaattcttcgttataaagaatttcttcgccatgtgaagagcaaatgagcgttggtttgatttgatctatgattgagccgctatcgatgttctcatttatatcaacactgaatcttcttataggtgggtgtaaatcctccttacttgtgataaaaaggtcgcccgttaatagcgtacgatcgattttatgatcatacacgacatgccccggcgaatggccaggtgttaaatagtatttcagaggcaggtgagcaagcgtttgctccgtcagcggctggacaatatgggctacccctgtgttctccacttcatttttgttcggatatggctcttccccattgatgtattttagttctttctggtgcgcaaaaatcggaatatcaaatctcactaaccattttgatgcacctccgatatgatcactgtggccatgggtaagcaaaatggcttttggattgccgatcgctaacgctgccctaatttgagcatcagcaaaacgttctattcccgtatcaacaatatatacatcatcaccatctttgataaaccaggtatgaaccggaatccgaagaggcacatcaagctcaaattcacattgatagacatgctctgataattgtctcaagttcacgcaaaccactccctttggagatttttgatagtttaaaagaaaaatagaagtgaacggactattttcaaggcagattatcttgaaaatggtcccacactccagcggaccggtattcttgaggaggagacgccgattttcgccagcatcagctcgacttgttaacattgtccattaataatccctcttgttccccttcttcacatactcccaatcacgttctatattcttcctcactctatgaaggagtgcagaaatggtttccttttcctctgaagtaaaaccggacaaggccacttccgtggaatgttctccttctcttcttaacaatggatatacctttttccctttctcagtcgggaacagtttttttatttttttattttgctcatctggcagtttttgaataaatccctgcatttccagcttcttaatggcccgcgcggccgttgtccggtccacctttatcatttccgccaatttttcttgaataattcctggattctcgtatatacgtacgagatagaggtactgccctcttgttaagtccaaatctttaaattcgatgttgcttatggaatccaacgctcttgctatcatgccgatctcacgcaaaatatcattcattcctaaaacccctcacgtatttttgttgcaattacaacaaaaatgttttaaccttactattataagaccacatgcgtgctgtacagtccagactaatatcagaaaaggattgattcataatgaatataaaaagaataacaactgaagctgatttacatgaagctttgaatattagaaagacggttttcattgaggagcaacatgtatcggaatccgaagagttcgatgaatttgatacgctccaggaacaatgccagcatgtcttggtatatcatgagaatcagcctgtcggcacgggccgtgtgcgcatcgttgaccatacagcaaagctggaaagaatctgcatcctaaaaccttaccgtaagtatggattgggaaaagtcatcgtaagcgggttagaagaaatcataaaagaaaaaggactgactgcatgtaagctgcatggtcaaacacaagcagcaggcttttatcaaaaactgggctaccagatttcttcacaggaatttatggaagacggcatccctcacgtcctgatgacaaaagacatatcgcggatttaacatgaaatatattttttacggattaggaatacttatattaagtttgggcatttccttaaccatacaatcaggactgggcacatcacccttcgatgcccttttggtgggtctgtcaaaagaaatcggtcttaccgtaggaagctgggaggtccttatttctgtgatcctcttaatctgcaacgctatattaacgagaaaaaaacctattttgctgggcttgattacagcattcattactggaataggcattgacctatggttgtttgttgtaaaaaacaccctctatctaaacgcgttgttaagcaaactgatttgtttcggaattggtttggtgctcatcggtcttggaacagccatctatcttcagacgaaattcgcatcaacgcccatcgatcatttaacacttattatccgagatctctccaaaagaacaatcttgttttcaagaacattggtatacgctcttttcttagtattagccatcatctttaaaggccctatcggcatcggaaccctattaaccgtctgtttgggaggaatgatccttcacgtttttatgcctattgtggaaaaacaattcttatcaaaaaaaagaaggggttaaaaaacctcttctttgaaaaaacgaaacgcaaaacaagctacgtttcgttcaataattttatgataaattaaaatttatagtaccaaaaaatcgcaatttcatttgctgttggaaggttggaataaagcatcgtatcaactgcacctattataaagtgatgtttggcataaaaacgacaagctgaaacattaatatcttgtgtttcaagcataagaccaaaaaagcgattctcctttgcccactcaatcgctttatgtaataatgctgttccaacgcctttttgtctatagtcttttgcaacggcaatgtcctctattagtgcatacccattccagttagaacgaatcttaatccggccgatgcagttgttttcaacataatataaaaaaaccgcttttccctcttcttcaacataactaacatccatttcatcatcttcatattgtttaaaataaggtttagaaaatcgttcctcagtatatgtccaaacaccgttttcaaaagcaggtatcattctcccaaaaacaacgaaaggttcatttggtttattgaaatctttcaaattcatttgagtcattttcttgatcatatcaatcccctcctaaacgagattatattagcatactcgtttcgatcgataacagcttccaaaagggcactctttaaaagaacagcatccattaccttttatataagcgatttttctatttcactgtcttaatggggtatttcaacagaggcttgtggtacagtaaaaaggaatagaaacaagagaaaagaagatgaacctatgcccactaacaataaactcaatgagaaatatcatacttccttcaactcgcccacaaccctgttgactagtatccgtggagagaggaagctttgacacagcttctgccattgatgacatctctattgaagtatccaaaggacaaccaaggatcgctatttgactttttcaagaagaaagtagagtgaataaaggagtgattgagtatgttaacaagagaagatatctttaaacacgtcaaagaaaaatacggtacatcgcctgattacccgtgggagaaatacccaaactatgcttctttgagacatacatcaaacaaaaaatggtacggtcttatcatgaatgttctcccagaaaaattaggcttggatggtcatggcgaaatagatattctaaatctaaaatgtccccctgacataagtgatagcttaagaaacggggaaaatatcttacccggatatcatatggataaggaacattggatttcaattgttttagaacggacagatccagaaggcgaaatctataacttaatcgagcagagctttcatttaaccaagtgaagataaagagtgttccggctaatcaagctgcgaagagtagtgggcactttcattttaggatactgttcttcactcagtccataaacgcaacttagtctatctggtgcgagagtgggagaagaatttctaccaacttcttatggaaaaggatgaatagttatgacaaataacttaaaacagagaagaatcattttagatttagcagttactttagatggttttattgaagggaaaaatggagaagttgattggtgcattatggaccctgatatggggtttactgatttcttaaatcaaattgatactattttatatggcagaaaaagctacgatttatggggacaatatattccaaaagatgaagaccctgatacagaaaaggaaatttgggaattggttcatagtaaaaagaaatatgttttttccagaacacaaaatgagattgataatcaagccatatttataaatgataatattcttgaagaaggaaataaattgaagaaaaagtctggcaaagacatctggctatatggtggagcgagtctcattacaacttttataaatttggggcttgttgatgaatttagattatctattcaccctgttgttttgggagaaggaaaaccgttgtttattgatgtaaaacagaggataaatttaaaaatggtgaatacaagaacattttcctctggcgttgtgcaaatcgtttatcattggaatggctaacattgtaaagtaacactcgacagtaatccttcttattgaactaaaggggaatccataaataatgggttccccttaatatactatggaactatcaatatcaaattttctgtaataaaagaggattgaaaaggacggtgtctcctccattaacatcattaagcattatagtatattttcttctccctcttttaagtaaatcggctaagttttgtgtttataaaaaaacgaaagaaggtgatcctatgcccaataacaataaatccaatagattaatcgctgagaagtctacttattttacttcaacatgctcataaccctgtggactggttcccttggggagaagaagcatatgaaaaagcgaaacgcgaaaacaagcctgttctcgtatctattgggtatagctaacgatggctaatctaaagaacatgctattgatgccatgtttattcattttacaaaaaaggatcaaccttgaattactttcacaagattgatcctttcactcatttagccatgtctccgcgaacgtttatatacattcaagattactagccaacaaataacaatgattcctgcaaaaagtatgagcatattgctatacaaataggtagagtgatcaacgtcaataggcagcagcctatgatctaggaagccgatagataataaaccgcctacaatcgcaatacccgttccctctgataaaaagctcgtgaaattaagcaaactcattccagcgcccgcttccttttctttcaaactgctagacacaactgtagatataactgtttttgtgaaagatagccccccaaaaacaaaaattactataattgtcatgatccatggtgctgcatctataaaaaaggcagcgattaaaaagccggaagaaagcaatgcacttccaatagttagtacatacaaggaacctttccgatcaacaagcaatcccccaatgtaaccaaagatgatgacactcattgttccggggaaaataatgccgcttccaattgctgcagtacttaaatggtgaacatctttcatcatgtaaggaaccatagagacaaatcctgctactgtaccaaatattagtcctccgcaaagggttccaatcacaaaaaagacgtttttccctaattcagggtcaacaaaagggtcctgagctttcctaatgtgttgcacaaatatgaagaaagcaaggatactgatgatcagaaaagaaaatctataagatgttgtaaacagcataaaaaatacgatacctgcagacatcaatataatccctgccatatcaatgtgtcctcttattctctcttcctttttcaacaattttataaggaatggaacggtgataattgttgcagttggaataagcagcaaatacgaccaatggatataatgagcaaccattccgccaatagctggcccaacaccttctcccattgctaccagggacccgatcaggccaaatgctttccccctgttctcttttggaatatagcgcgcaacgacaaccatcacaagagctgggaatgcggctgcaccaattccttgaataaatcgggctagaatgagaataggaaagaaagagtgtccaacaaatccaatgatcgaccctaagccatttaccataatcccaaatagaagcagatttttgatgcccagctggtctgatagctttccatatagagctgttccaatggagaaggttaacataaaggctgtattcacccagtttgcacttgctggcagtttattaaactcgttggcaatatcaggtaatgagacgttcagaaccatttcatttaatacgctgaaaaatgatagaacacaaagccaaatcaaaacttgattgtgccgtaaagttgactgtgaataagacgtattcacaatttcccctccattaatgagggcagacgcagtttatagggtcattgatacgcttccctcttttaattgtaccctgttcattttattgcacttcataataactccccctacatttgattgatatgatcttattatatatagactaaggattaaacttttactttttttataaaaatttgaccagattgcgaaacaaggaaaaacgttattcgcatttatctcaagtggcaaaatgaaacattagtttatattttcacatcacaattatcgataagcagtcagttattgtatttgtttaggataactgtggtaacctgaatataaccaacttaggaagaaggtgatcccatgccaaataaaagtaaacccaatagattaatcgctgaaaagtctccttatttactccaacacgcccacaaccctgtggactggttcccgtggggagaagaagcatttgcaaaagcaaaacgcgaaaacaagccggttctggtcagcatcggttattcgacgacttgtcattggtggcctaggataatcaaatcgtgtggaactccattaaaagataacagaagccattttaaacgataatactatttgttcaaacaatacagtctaccttttatttcattcattttctaaaacctgtaatccgtaaccacgcggtagcaggtttttttatttgcttgacttagagttaactctaaattgtaaactaactttaattaaatgagagggatgatgttgttgtattccattagtaaagctgctgagaagactagtattagttcgtatacattaagatattacgaaaagattgggttacttccaccaccaaaacgaaaaaacagtggaaggcgtttttatacggagactgatattcagttcatgttattcctgaaaagtttaaaggaaacaggtatgtctttggaggatattaatgagtttgtcaaagacggatgcattttggaaaaaatcaattcggatgttaaatcggcacaactctccccatctataaataaacgtattgagattttaaccaagcacttagagaaaatggaaattaaaaaaagggagctggaagaagtgatttctactacaaaaggaaaactggatacatatttttcaattttgaaagaggaagtggaaaacaaatgaaacatttaaatatatacataatgttacttggcttctctattttcacgggagctacttttaatcttgcaaaatatacagttggatatttttctccatcgtcttctgcggcatggcgtttcggtttagcggctgcagtgatgctcatcattttgatttttactgaaggtataaagaagagtcaattacggaaaaacgccgtttcatacattattcttggaattataggaatctttggatttaatgccttgttttttgttggtttaaaatatacatctcccgttaacggagcattaataatggggctgaatcctttattaacagcaattctcgctcgaattatcttaaaggacaacatgacaaaaaaacaagtactcggcatattctttgcattcatcggtgtattgttagtcattacacaaggttctatcgaaaccattaaaaccttatcaatttcaggaggagacttaataatctttacaggtaacgtttgttgggcactttatggcgtacttggacgtcggtttgtaaaggatggtacaccgctatctacaaccacttatacgatggttattggtgctgttagtttaatagtagtttccttatttacatccaaacctgtttctttatcgaacatcccgattggagtttggggggcaattgcttttatggctttctttacaagtgttttgggttacctatggtggaatcaggggattaaagagattggggctagtaaaacatctttatttttcaaccttgttcccgttgtaacgatgattatttcatttgccgttggaacaccaataaaggtatttcaagttattggggctgtgctagttatattaggcgttttaaccgcttcgggggtaatacgtattcctaagtacaatactaaagaacagtcagctatataaagaaatagggagtatttttgagaaaatgtgttaagttaaatatacactaattataggaagaaggtgatcccatgccaaacaaaagtaaacccaatagattaatcaatgagaaatcaccatatttactccaacacgcccacaaccctgtggactggttcccgtggggagaagaagcttttgaaaaagcaaaacgcgaaaacaagccggttctggtcagcatcggttattcgacttgtcattggtgccacgttatggctcacgaaagctttgaagacgaagaaatcgcgcgtcttctcaatgaacggtttgtggcgattaaagtcgaccgggaagagcggccggatgtggattctgtttatatgagaatctgccagctgatgaccgggcagggcggctggccgctgaatgtgtttatcacgcctgatcagaagccgttttacgcgggtacatattttccaaagacgagcaaattcaatcgtcccggttttgttgatgtgcttgagcatctgtctgagacgtttgcgaacgaccgtgagcatgtcgaggatattgcggagaacgccgctaaacatttgcagaccaaaacagccgccaaatcaggcgaaggccttagcgagtcagcgatttcccggacattccagcagcttgccagcgggtttgatacgatctacggcggtttcgggcaggcaccgaaatttccgatgccccatatgctgatgtatttgcttcgttatcatcacaatacggggcaggataacgctttatacaacgtgacgaaaacgctggacagcatggcgaatggcggcatttacgatcatatcggctatgggttcgcccgctattcgaccgatgacgagtggctcgttccccactttgaaaaaatgctgtacgacaatgcgctgctgctgactgcttatacagaagcctatcaggtcacgcaaaacagccgctataaagagatttgtgaacagatcattacgttcattcagagggaaatgactcatgaagacggaagctttttctctgctttagacgcggatacagaaggagaagaaggaaagtactacgtgtggtcaaaggaagaaattctgaaaacgctcggggacgatctcggaacgctgtattgccaagtgtatgacatcactgaagaaggaaactttgaaggcaaaaatattcctaacctcattcacacaaagtgggaacaaatcaaagccgatgccgggttaaccgaaaaagagctcagtctcaaactcgaagacgcaagacagcagctcttgaagacacgcgaggaaagaacctatccgcatgtcgatgataaagtgctcacctcatggaacgcgctgatgatcgcgggtcttgcgaaagcggcaaaggtataccaggagccgaaatatctcagcctagcgaaagacgccatcacatttattgaaaacaaattaatcatcgacggccgtgtgatggtccgatatcgtgatggcgaagtgaaaaacaaaggctttatcgacgattacgcttttctcctatgggcttatctggatctctatgaagcttcgtttgatctatcttttttacaaaaagcgaagaaactgacagacgatatgatcagcttattttgggatgaggagcatggcggattctacttcaccggacacgatgctgaggccttaatcgtccgggaaaaagaagtgtacgacggcgccgtgccttcaggaaacagtgtggcagctgttcagctgctgcgtcttggacaagtcacaggcgacttatcactgatcgaaaaagcggaaacaatgttttccgtgttcaagccagacatcgacgcgtatccgagcggccatgctttctttatgcaaagtgtgttaaggcatctgatgcctaaaaaagaaatcgtgatttttggaagtgcagacgatccagccagaaaacaaatcataacggagcttcaaaaagcctttaagcctaacgactccattctggtggcagagcagcccgagcaatgcaaagacattgcgccatttgcagcagactaccgcatcatagacggcaaaacaaccgtgtatatttgtgaaaacttcgcctgccagcagccgacaacgaatatcgaagaagccatccaaacgttaataagcagcagggattaagacccttgctgcttactttttgatttcttatggtaccataaagcgatccccgcaaacacaagattgaccgctatcgtaaagaaagcctcccacatcgggttcccccgcgtaaccgtaaagagagaaggaattcctccatacacactgtttttttctgtaataaacatacacaaaaacatattattcgcggcatgggcgccaagtgatatttcgatgcttccagttttaatcgtgtaataggtccacacaaaaccaaatgttaaatactcaattcctgcccagacagcgccattgttcatttctggattcgcaaaatgcaatacgccaaacaatcctccgacaatcagtgtcaaaaatagaggatttttcgtcaatctcccgaaagcttgaagcaaaaatcccctgaaaaacagttcctcagctgatgtctgaatcggaaccaaaatgagggcagccgctagcagccagataaagcgtgaggcattaaactcttgcattgaatagctatcaggatgaatcgcaaaatcaatcaattgtacggcgatcatcagcaagaaataagcaataaagccaaaggaaattctccgccaattcatctttgaatttggtgtaatcacagttcggaaaggccgcttcaaaataaagcgcacagccagccaaactcccggaatggcgaataaataaatcacatgggacaaataaagatctacgaggggatcactcagcacagcttcatccaaatcaaacgtgatattgggattcacaataaccgtgaacagtatagcgaaaaggtaagctatattcccgaatacatataaccctaccatcaccaaaaaagcgaaaaaatatctccacaacgtattgtttccttctataggacggataaatgaattcattccttctatgtctcttcctttcaatgagaatattactatatatttgcataaattggtctatgaatctactgttttggaaatcttttaagcaaaattaaaatataaagtgtgaatttagttcttccatctagtgatttgaactctgttgccaatgaaccaagatacttataatagtcctaagaggggaattttcagtcttttcttactactcaaaagggggttttttatgaatacgatcttcaaacaaaagaatacacatcctttctcaaacgcagcgaatcgtttagaccgccttccgatttcacgcgttcatttccaagtgttaaccgctctcggcattgtttatttctttgatctcgcagatttatttaccctcagcaatgtagcgccggcactgatcgagcattggggcatcccgctttcaactattgctaacgtaacggctgcttcgtttttaggcatgtttttaggcgcttcactgggcggacggctgtccgatcgaatcggccgcaaaaaagccttaaatctatttgtctttgttttttcaatcgcatcgctatgcaatgctgcggcatgggacattccatctttaatgacattccgttttctcaccggatttggcgttgcagccgccatggtcattacgaatagctatttggcggaatttttcccttcaagtgtacgtggaaaatatatttctttttgtgccatgattggattgatcggggttccgatcaccaacattgtgtctgcctttgtcattcctcttggttcatggggatggaggctagtatttgtatggggtgccgtcggccttatttattttttctttattcgacggctggaagagtcgcctcgctggcacgaaaatcgcggggaatatgcgaaagccgatgcgatcctcaaccgaattgaggcacaggttgaaaaggagaaaggcccgcttccggcagcatcccagcctaaagtaagcgaaactgttaagcagcatgcaggttacgccggcttattgaaaggcagaaacctcaaaatcaccatcgtattatctgctgtatggatttttgaaacgtttgggttttacggatttgcctcatgggttccaagcctgttaaaaagcaatggtgtcaccatggaaaatacattgtggtataacgtattgcattccgtcggcgctccgcttggcgcactgctcggctccatgatttctgaaagatttcaaagaaaatggattttagctgcgagtgcgtttctgacggccatcgccgggctcttatatggtatgacttttattcccatcatgatcattgtctttggttttatcgtgaatatcacagaacgggtctttacctcgaacttatacgcctatacatctgaaccttatccgactgaataccgctcgtctggcagcggtttagcctatggtcttggccgtttttcaaacatttttggctcattgcttgtcggatttattgccgttcagctcggctatatcagcgtcttcttatttattgggggctgctggctcgcatgctccttgctgttaatcttcttcggtcctaatacgaatgcgaaacagatttaaaaaagtcagtgcggatctgccgcactgatctcattacaattgcttcaaaatcctcgcggggtttccgcctacaacagtattagcgggtacatccttagtgacaacagatccagaagcaatcactgcgttatcaccgattgtcactcccgggttaatcaccgcccggcctccaatccaaacttgatctccaattgtcacaggcttaccgaactccttcccggatttcctttcgatcggatcaagaggatgaccggccgtgtagatatgtacacctggcgcaatcaaacaatgacggccgatacgcacctcacacacatctaaaatgacacagtcaaaattaacaaatgtatgatctccgatatgaatgtgatagccataatcacagcggaatgtcggcaaaatcgtgacttgatccccaaccgaaccgagcagctccttcaaaagctctgtccgcactatatcatcttccggtgtttcgttatattgtctaatcagctgtctcgcatgcttgcgttctagtaatagttgttgatcttccgaattgtataattctccggctgccattttttctttttctgtcctcagcatttaagtcactccatgtcagattgtaatctcgatcaaatttccttcatcatcctcaatcacactttcatagtagccgtctcctgttgtccgcgggccgttgacgacggcaaaaccatccgccttcaaccgagcagtcagttcatccactttctcccggctcccaacggaaaaggcaatatgtgcccagcctgtcattgtttgtgagggcggatcggtcacatttccttttttcataatctccagccttgctccggaaccaaacgtaataaaataagacttaaaatcttttttctcattatgatacaaatcattcgcttcgccattaaaatacgattcataaaaagacttcattcgctctaaatcattgacccagaccgctgtatgttcaatctgcatttcttcctcctccttcgccttcaatgaagttataaggtatgaaatgcatttcagttcaagcttttttcttaaatttatgctgaattttgatatcagcgggttcatcctgcaaaaatagagaaaatgctgcgatgccgagctgctcaagattcaaatcaagcgacggaaaaccaagaacacggctgatagaagtatttccctcgcctatgatttcaacatcccaattactctttttggcaaatagatgaattccagctgccacttcatcactatttgcataaatagcagtcggaaccctcccgctcatataaaaatgttcagctgcccgctcaccatcattcatatcgttgcatccggacagcatatggcggtcttccaaccttccgcagacagctttataggccgcagctttatcagccgtgctcgggctcctatcagcttctctgacacacgtaaaagcaatattctcatgcccgcggccctttaaatagcgaaagctctctgcataagcagcttttctgtcattaaaagcacaaggaacatcaatgtctccggtatcctcacaagcgatgatcggcccatattcctgataagctaaaatgctgtcccaatgattggcgcgggaagtaatgatgagaccgtctattttcttcgttcttaacagctctaaatatttgatttcaatatcggggttataattggtggggagaagggtcgttgcatactcatactgaaaagccgccttggtgattccgttaacgattttatcaaagcagggatgatcgctataaggcagaatcacaccgaccgtatgggttttcccgcgaatgagatcgattgcggttcgatttggcgtataatccaattccttcatgacttgatgaacaagctttctcttttcttcagatacataaggatggtgattcaatacacgcgagacagtcgaaacagatacatttgccagtcttgcgatctcttttatatttgccatctctttctccttttcatataaaaaaagcagtaagtgtaaaatccttactgctatctcatcatatattgatgataagttcaacaggacaatggtcggaacccatgacgtccgctgatatgcaggcatcttcaatctgttccttaagtctttcagaaacaacaaaataatcaatccgccatccgatatttctgtcccgggcgccggcacgatacgaccaccaggaataagcgccttcaagatcaggataaacatgacggaaagaatcaacaaagccagcttctaagaaacgagtgaatgcccctctttcttgatctgaaaatccagcgttattccggttcacctttggatttttcaaatcaatctcctgatgggctacattcaaatcaccgcataaaatcactggttttttctgatccaattcaagaatataagacaataaagcctcttcccattgcatgcggtaatcaatccgctctaatccccttctggaattgggcgtataaacagtcatcacatacacgttttcaaattccagcgtaatcactctgccttcttggtcatgctcttctactccgataccgtagatgacctgcagcggttcttgcttagaaaaaacagctgtgccggaatatccttttttcactgcataattccagtacacatgatagccttcaggctggagatcaacctggccgtcctgtatcttcgtttcctgaagacatataatatctgcatcctcttctttcaaataagagaggaaatccatttttctcatcacagcccgcaggccgtttacattccatgaaatcaacttcatgtttcatcctcccccctataaaaaagagcaagaacccgaaggtccttgctctttacgcatcagcttactcaccgcttacgtatggaagtaaagccatttgacgtgcgcgtttgatcgctgcagtcaatttacgttggtatttagcgtttgttccagttacacgacgtggtaaaattttaccgcgctcagaaacaaactttttaagaagatctacatctttgtagtcgatgtgcgtgataccgttagaagtgaaataacacactttacggcgtttcgcacgaccgcctctgcgtcctcctgccattgtcatttccctcctttctttttcattttaggcgataatcacattagaatggaagatcatcatccgagatgtcaatcggtttgccgtcgttggcaaatgggtcatcattaaagctgttcccctgattgcgtctctggttgttttgatttcccccaaatggattatcattttggcctccgccaaagtactggcctccgccgctgtttccttcgttgtatccacctgaaccagaaccgccgccgtttttcggctcaagaaattgaacactttcagcttggacctctgtcacgaagacacgctgtccttgctggttttcatagtttcttgtttgtaaacggccatctacgcctgcaaggcttccttttttcaagaagtttgcaacgttttcggcttgtcttctccaagtgacacaattaatgaaatcggcctcacgttctccggactggttcgtaaatgtacgattcacagcaagagtaaacgtagcaacagccgcaccgtttggcgtataacgaagctctgggtcttttgtcagtcttccgactaatacaactcggttaagcataagaaagaccaccttttaccattatatatttcaaaattgcttattcttcttctttaacaacaatgtggcgaatgatatcgtcactgatcttagctagacggtcaaattcttgaactgccgcagcgtcagattgaacgtttacgatttggtagaaaccgtcgcggaaatcgttgatttcgtaagcaagacgacgtttaccccaatcctttgttccagtgatctccgcaccgttagaagtcagaacgttgttgaaacgctcgataactgcttttttagactcttcgtcaatgtttgggcggataatgtacataacttcgtactttctcatctgtttgcacctccttttggactaagcggcccataatgggcaaggagcaataattctattactcacaattttatattataccaaagctcttgtccctttacaactgcatcctatacattaaatcggaaatgaataacatctccgtcttggaccacatattctttcccttcaaggcggacttttcctgcctctttagctcctgccataccgccgcccgcaagaagatcctcataagcaactgtctcagcacgaatgaagccccgctcaaagtcactatgaataattcctgcacactcaggtgctttcatgccttttttgaatgtccaagctctgacttcctgttctccggctgtgaaatatgttgcgaggccgagaagagagtaagacgctttgatcagctgatcaagacctgattcttgaatgcccagctcttccaagaacatttgcttttcttcgccttcaagctcagcgatttcagattcgatttttgcacatacaacgataacttctgcgttttcgccggcagcgtactcgcgaatcttcgctacattttcattgccagatggatcagcaacttcatcttcacttacgttggccacgtacaaaataggcttcgaagtcagtaaatggagctgcttcacaagcttttgctgctcctcagtgaattctacagatcgagcaggcttttcactctcaaacgcttctttcagtttagataaaatctcaaactcaaatacagcgtctttatctttttgcttcgcaagcttgctgacgcgtgtaatccgcttttcaaccgtttccatatcagcgaggatcagctcaaggttgatcgtttcaatgtcatcaatcggatcaacctttccggaaacgtgtgtaatgttgtcatcggaaaaagcacggacaacgtggcaaatcgcgtcaacttggcgaatatgagataggaacttgttgccgagtccttctcctttagatgcgccctttacaatccctgcaatatcagtgaattcaaaagcagtcggcacagtcttcttcgggttgaccagctcagtcagcttttgcagacgatcatccggcacctctacaattcccacgttcggatcaattgtacagaacgggtagttggctgattcggcaccggcctgtgtaattgcgttaaatagtgttgattttccgacgttcggcaaaccaacaattccagctgttaaagccattctttcatctcctctatataaaaccgtcattgtatgaacgtattttgaacctagagcaattataaggaggttcactggaaaagacaagctgacaaaaaagcattttcagcctgccaatccctttgattatgcttttttcaagcctactaaacagtcaaaaagcgtacttcccattccattatcagaatttgtatcatttgtcagtgcattgactgaccctccaaaagccgcccacatgccttcatctatattaatcgtcttcgcatgagcctgcttcatcactttcaccttgcccttcaagcgtccgcggtcattaaagataacaacttcgtctccattctgaagatcctgctcagccgctatatctggagaaatatcgacctgaacgtgctgaagcttttcaataaacggcacatgctgtgaatggttggaacgctgcggatgaatggataacagcgtataagggtacttttcagctaactcctcattatggaaaacagattcttcgggcacatttaattgaagcgagccgctaaatcctttttgctcagctagcgacgaagtaaattcaaattttccactcggcgtcaaaaactgataatcatcccacggcacctgttttactggaagagggaggtggcctttttcttttaaacgctcaagtgtcacatcctctgcttccaatgaagaaagccccatctctaaaaattcttgagtgctgtattcaaacagctcgccaaatccaaggcgttttgcaagctctgaccagatccagctgtccgacttcgcttcaccctgcggctccacaagcttcttcccgtactgaacataatgatgatacatactggaatagtagatatcttcttcttcaaaaacagtggcagtcggcaaaacataatcacacagctttgcggtatctgtcataatggaatcaatcgcaaccgtcatgggaaccttttcaaaagcttgtctcaccttatttgtattcggcacctgagtcagcggatttccgcacgtcacaataatcatctcaatcgcaggatcagcagcggtcaacacttcttcagcctgcgtcatcattgaaaaagaacgtgatgttgtttttaattccggcaacgtcagctttgtttttgcaaagctctcgccaatctggacatttccgaaattcgcgccgccgcccttaattccgacatttccgcttgccgcaacgagtgcatcaatccaacgaatcgttcccccgccgtttttatatcgctgcatgccaagccccataaaagtagacaccggaccatcagcatacaaaccggccagatactccagctcctccatagaagtttctgttttcacaataaactcttccagagaaacagttttcaaaagctctttcacatcatcaaaaccgacagaatgctcagaaataaacgtttcatccgttcttcccgtctcaatcagaaccttcaaaacggctgccgcaagccagccgtccattccaggctttacagagatatagcggtcagcaagcttagcagtcgggttgaagatcggatcaatcaccgtaatcgtggcgcccttctttttcacctgctgcaagtgatggtataagtgcatatttgttctggatacatttcttccccacacaacaacatgcttgctgttgtaaatatcaagcgggccgtgaccgtacgaacggccaaaatcccagctttgcgcctcgatgccggagccccagcatatgcttccgacgatttcagtcacgcctccatatccattaaaaaaacgctgatcaagcgcttttaacagaccgttattcgcataatcatggctgtgcaaaacagcagtcgtctccgacgtttccttgatttcccgaagtttatcggcaatttcatcaagtgcctgctcccaagaaatccgcacaaactcgccattttgttttttcattggatagcgaagccgatcaggcgaatttgtttttgtctcaagcattctgccgcggccgcagattttaccttccgtaatcggatggtttggatctccgtccacttttgttacctttccatcaacaacagtcaccaaaaagccgcagctgtcccaacaattcagcggacatgccgactgatgcactttgctcatcgccgtcttctccttaccttctatatgaaaaagcatgagtgtcggcctatttatgaagtaggctcctcatgcttgactagtactttttttagttttctttcaaattctcttctcggaatcataacactgtgagagcatccctcacacttaattcgaatatccattcccatgcgtataattttccagctgttcgctccgcatggatgcggttttttcatttctacgatatcattcaggccaaagtctttatccgccaagacccttcacctcttttcctaaactgctgtatctattgtacaaaaaaactgatcataagagcaatcaagatacccgaaaagaaatacatcctcttatttccatttactcaaaataggatataagagcagacaaactaacaaatacaaattgagcatcccatatatcggatacaagaacgcgatcaaatcagaaaatccgaaagaagtaaaaggcaccattaacactaacaaaatcaacacaatcacccatctcggcatatgaataaacgccatcagccggctggacagccccagcaaaccagctaccgtcgtcgtgtaaatcgccaggcacagcaccgccgtcatacataaaaaaaggaaataaggcgcaccctccagaacggcaaacagcggtatttcaaactgagaaagggagcccgccagctccaccaacgtttcattataaacaaatgagatcacgccaaaaataagaccgcttgccacacttgcgatttttgcttctccgagccctttcatctctttcccaacagaggataaaatcgcaacaactgaaaggatgtttaaagaggtaaacgtaatgctcgcaggccagttatactgctgggacaaatcaatcgtccacgtatggtgatgtgtgctctgaaaggagatcagcgcatataaaagccccgctactaacacaggaatcaaaatactatttatagataatattcctttcacatcccacaaaaacaaacacactgtcacgatgcaaatcagcgtgattccccaccagaaaggaagcttgtacatttgcagggtcacaccgcctccggcaatcatcaccatagtcgtcgaaaacaaataaaaaatgatgaggacatcataaattttcgccagccatggccccattaaatgctccagaaccggcagaaaatgagtggattgaactttaaaactgattttcatcacaatataagacgagaaaatgaacatgattgtaaacagcacaatagcaagtccgctttccgccccaaaaaactgccatatctcctgaccgctcgcataaccggccccgatcaggctccctaatatgagcagcatccacttcattccggctctccacaacactatcacctcatagacaaagttcagcttgtttccgttattgttactatataaataaaagaaagcaaacatgccatattttcatagacatttaaatacaaggtgaaattatcatacgaaatacacataaaaaaagactgctaatggaggcagtctaaaaatatatcatcttgcagtggaatgaaggaatgaacctcattaaccattcctatctataaagtgttttgtaagcaaaccgtagcttgatcatgatcgaggcaatgggggacaatatttataattcacccactaaccattcataataacctctacttttttaaaatctccggtgtcatacacaaagcataaaaaaccgtactgctggatatactgtaaacaaccttacataacgaaacacacaccatagcaattctgttacctactataacaaggaagtgaaacctatgaatcgaaaaggcgggcttttttcctctcaggaacgagtaaaacaatatgtttcacatacagatgcagctgcagcaaaacaaatccaaaccattctttcttcatccttacgtaaagctgccggcaaaccaattgttgtggtttgtatcggaacagaccgttcaaccggtgattcattgggcccactcgtaggaatgaaactcaaacagatgcagctcaccagattccatgtctacggaaccttatctgaccccgtccatgctgtgaacatgaaggataaaatcaatgacattcataaattacataaaaacccatttgttatagcggtcgatgcatgcttaggccgcgttaagagtgtgggttcatttcaaatcggggacgggccattaaagcccggagccggtgtacaaaaagaccttcctgaagtgggagatcttcatattaacggaatcgtgaatgttagcggtttcatggaatattttgtattgcaaaatacaagactcaacttggtcatgaatatggccaatgttctcgcggaaggattgagtttaacagatcggacagagtggaggcaagaacgccttaacccgttgcaaaggctcactgggcgcatataaaacaaaaaccatcttcgcttgaaagatggtttcttcatttacgattctcgttcagataaaagctctaaaatccggtcaaggtcttcattagagaaaaattcaatttcgattttgccttttttcttctgtcttttaatattaactgttgttccaaaataattttggaggtaggattcccgttcttttagaaccgcatctttcacaggttcttttttctttgtttcacgtggaacattctgattcaactgctgaatcagctgctcaagctggcgaacattgagctgctccgcaatcactttttgtaccagcggttcaagcttatttttgttttttaagccaagaagcgtgcgtccatgtcccatagaaagcgtaccttcggcaataagctgctgaatattttctggcagtgtcagcagtcttaaatgattcgcaatatgcggtctgcttttcccaagacgtttggcaagctgctcttgtgtgagatctaagtgtttcaacaaggaatcatatgcctgagcctcttcaagcggagataaatcttcacgctgaaggttttctaataaagcaatttccctcattaacgcctctgataattcacggacaatggccggaactgtatctaaacctgccagctttgccgctcgaaaacgccgttcacccgcaacaatatcatagccttttaaagattttctgacgataagcggctgaagaatgccatgctgcaacacagattcttttagttcagctaatgcctcgtcatcaaagtgttttcttggctgataaggattagggcgtaaatcggcaattttaatttcttcaactgtctcttcagacaaatctacctgattaaataacgcattaatcccttttccaaggcctttagccattcgcagccacttcctttgctaaatctaaatatacttccgcacctcttgaccgcggatcgtataaaatgatgggttttccgtgactcggtgcctcactcagacggacattacgcggaataactgtcttatatactttatccctaaaatactttttaacctcttcaatcacttgaatgccaaggtttgtccgggcatcaagcattgtcagcaatacaccttcaatcattaaatcagtattcaaatgcttttgcacaaggcgtactgtatttaataactggctgagaccctccaaggcataatattcgcactgtacaggaatcacaacggaatccgaggcagtaagggcattaatcgtcagcaagcccaatgacggcggacaatcaatgataatataatcataattttgctttactgcttcaagcgctctcttcaatctcacttctcttgatattgtaggaaccagctcgatctcagcccctgcaagctgaatcgtcgcaggaatcacatccaagttctctactgtcgttgctttaataatatctattacatctgcatcatctactaaaatatcgtacacacactgctctacatcggctttttcaatccctaatccgcttgtcgcatttccctgcggatcaatatctaccagcagaacccttttccctatgtaagccaaacatgccccaaggttgacagacgtcgttgttttgccgaccccgcctttttggttcgtaattgctatgatttttcccacgatgtcacctactttcacatgaacatgtactatcttgcttctattctatcaaaaaaagattaaagcgtttcatttttttcatcattttgttccgaatcagaagggaaataattgaaaattcaagcacgctttatgctttctcttataaattctgcaatttctatgtttttttgacttaaaaaaggaatttcttaaagaaaaaaagaagaagtcacggtacagaacgtggaaacaggatggtgagaaaatgatttatcaaacgaagagagatgtacccgttacgctgatgattgtgtttctcatattactgatacaagcagatgctattgttccttttgtgctgggaaatatgagagtttccggctggatcatttttattctgctgactcttttaaatggactcatcatttggagctttattgacctaaaatatgtattgaaggaacaccatctgatcattaaagccggattgatcaaacatcaaattccttatgaaaacatcgataaagtcgttcaaaaaaagaaactgtggtccggttttcgtctgatcggctctcgccatgccatcacaatatattatcaggggggatggggacatgcagtgatttcaccgcaaaaatctgaagaatttatccccaagctcaaagaaaagaattctaatataataatattcactaaaagtaagtgattaccttttatttaaaatataaaaagctctcctgcttttcaggagagcttctattttggtatgcgaatcgttaattgaatatattcttcaaattcttcttcttccgtattcaattttacaccgctgtcttccaccattgatagtgactggcgaatcgtgttcatcgcaattcttgtatctctgctgaatgctttgcgtctcggctttggctttctcttgccttgctccagcattttcaccacgcggtcttccgtctgctttacatttaaacttttctcaataatctctgtgagcagtgtgacttggagctcaggctgtttcagcggaatcagtgctctggcatggcgctcggtgattttcttctccataattgcctcttggaccggctgaggcagctttaataaccgaagcttattcgcgattgtagactgcccttttcctaagcgctgtgcgagtgcctcctgtgttaaatcatgcagctcaagtagcctagcataagcatgcgcttcctcaatagaagacagttcttcccgctgcaagttttcaattaacgccacagaagcggtttccgtgtcggaaaaatccttaataattgccggaatcttttcccactcaagcgattgcaccgctctccagcgtctttcacctgcaatgagttcgtattggccttcttcttctgtatgcctaacaacaatcggctgaataatgccgtgtgtatgaatggtcattgctaactctttgattttttcatctgagaaaatggtgcgtggctgaaaacggttgggaacgatagcatttaccggtatttccagaatctcttctttgtttgtatcatgttcagcaatctccggctccggttccttctcaccaagcccgaagaaacgagagaatgaatgcttcatgtacctacaccacctttaaaaactgccatttttataattctattttctcatggtttttcctgctgtacatccatcaattttgatgaaaatatgatggtattgtcatatcaggctgtctaaattacccttcaattggcgatttattaggagttcccggttttcttggatacttcttaggtgtattttttattttgcgtatcaccataatattacgatcgctttcttcaataggcagcttaaaagaatggatattctcaagttctcctccaagcgtcgtgattgcttttttgcctgcattcagttcttcttcagctgatgcggcttttaaagcaacaaataaaccgtttttcttcaccagaggcaagcaaagctcactcaaaacagataatctcgcaactgctcgcgctgtcacaatatcatagctttcacgcacgtctttccgttgcccgaacgtttcagctctgtcatggcagaatgttgtattctccaattgcaaagcctcagatagcttttctaaaaacgtgatccgtttattcagtgaatccacgattgtgacattgaggtgcggaaagcatatttttatcggcagacttggaaaacccgctcccgctccgacatcacaaatcgtgttcacctgattgaagtcgacataaaaagtagctgtaatggaatcataaaaatgctttaaatacacttcttttttctctgttattgaagtcagattgattttttcgttccattcaaccagcatgtcgtaatacagctcaaattgctccagctgacggggagaaagggagatccctttttccgccaaaccagaagtgaattcttcaatattcatgccgtcatcctttctattcggctatcttcgcaatgcgtccctgctctaaatacaccaatagaattgaaatgtccgccgggtttacaccggaaatgcgggaagcttgggcaacagacaaaggccgtacatttttcagtttttgacgcgcctcggtcgcaatccccttaattgcgtcataatcaattcgatctggaatttttttattttccatcttcttcagtttttccacttgctgaagagatttttcaatatatccttcatatttcacttggatttctacttgttctgccacgtcttgaggaactggcacttctggcggcgccagttttgtgactgtttcatagttcatttcaggacgcttcatcaagtctgtgccgcgaactccatctttcaattcgcttccgccaagagaacggatatattcttgattttccggagacggcttgataattacagaatgaagacgttttttctccgcctcgatcgccgcttttttcttctcaaaagccgcatagcgctcatcagaaatcaatccaatgcgatgtccgatttctgtcagacgcaaatcagcattgtcatggcgaagaagcaatctgtattccgcacgtgatgtcaaaagacgatatggctcattggttccttttgtcacaaggtcatcaatcagaacaccaatataggcgtcagaacggcttaaaatcacttcttcttttccaagcgcttttcgtcctgcattgattcccgccataatcccttgtcccgcagcttcttcataaccggaagttccgttaatttggcctgcagtgtaaaggtttgtgattttttttgtttcaagtgtcggccagagctgtgtcggtacgattgcatcatactcgatcgcatagccggctctcatcatttgcacgttttcaagtccaggaatcgttgcaagcattctttgctgtacgtcttctggaagacttgtagataaaccttggacatagacttcctgtgtatttctgccttccggctcaaggaagatttggtgacgcggtttatcattaaaacggacaactttgtcttcaatggatgggcagtatcttgggcccgtacctttgatcataccggaatacatcggtgaacggtgcaggttgctgtcaataatctcatgtgtctcagggcttgtatatgtcagccagcaagggagctgatctgtgatatattccactgtttcatatgagaaagcgcgaggcacatcgtcaccaggctgaatttccgttttgctgtaatcaatcgtgtcgcttttaacgcgaggcggcgtacctgttttaaaacgaacaaggtcaaaaccaagttcctccaaatgctcagaaagcttaatagaaggctgctggttatttgggccgcttgagtaagacagatcgccaagaataatacgtcctcttaaatatgtccctgtcgtcatgacaactgctttcgcacgataatgtgcaccggtttgtgtaataacgcctcggcattcgccgtcttcaacgatcagccgctccacaattccttgcagcaatgttaagtttggttctttttcaagcgtatttttcatttcgtgctgatattggaatttgtctgcttgcgcacgcaatgcacgaaccgcaggaccttttcctgtattcagcattctcatttgaatatgcgttttatcgatgtttcttcccatttctccgccgagcgcgtcaatttcgcggacgacaatcccttttgcggggccgccgacagacggattacatggcataaatgcaaccatatctaggttgatggtcaagacaagcgttttggcgccttggcgtgcagatgcgagggcagcctcaacaccggcatgcccggcgccaatcacaatcacatcgtattggcctgcttcataccccatgattctagttcctccttttattattttcctaaacagaattgtgaaaagagctgatcaattaagctttcgtggacagaatctccaatgatttcccctaaaagctcccagcatcttgtaaggtcaatttgcaccatgtcgatcgggacatcctgttcgatgccgctaagcgcatcttcaatggcgcgttttgcttgctgtaaaatagagatgtgacgtgtgttgctgacataagtcagatcaccgctttcaatggcacccgtgtagaacagtgattgaatcgcttcttccagatcattgatgccttcctcttttaaaagagatgtcgtaacaactggacgtccattggcaagctcacggacacgttcagtgtcaatcttcgcctcaaggtcagtcttattcaaaatcacgataacatccatgccctcaacggcttcaaaaagcttcacgtcttcatcagaaagctcttcactataattaagcacaagtaaaatcaggtccgcttcctttagaacctggcgagaacgttcaacaccgattcgctcaacaatatcctctgtttcacgaatacctgctgtatcaaccagacgaagcgggacgccccttacattcacgtattcctcaatcacatcccgtgtcgttccgggaatatcggttacaatggcttttgcctcatgaacgaggctgttcagaagagatgattttcctacgtttggccggccgataatgacggtagaaagaccttcacgtaagatttttccttgctcagaagtcctcagcagcgtctcaatttcctttttcacggcggttgccttttcgactaaaatctgatgcgtcatttcctctacatcatcatactccggataatcgatattcacctcaacatgggccagtgtttctaaaatctcactgcgcaaacggcgcaccaaagcagaaagacgcccttccatttgattcatagcaacgttcattgcccggtccgttttcgctctgattaagtccataaccgcttccgcctgtgaaagatcgattcggccgtttaaaaacgcacgtttcgtaaattcaccaggctctgccagtctcgctccctctcttaatgcaagctgaagcacttggttcacagtcacaattcccccgtgacagttaatctcaatgacatcttctcgtgtaaaagttctcggtgcttttaacactgataccattacttcctcaacgacacgatccgaaggtctgtctacgatatgaccataatgaatcgtatgtgattcgaccgagctgagtgttttccccttcggtcccttataaattttatctgcgatttgaatggcttctggtccgctcaaccgtacaatcgcaatcgcgccttctcccatcggtgtggaaattgccgcaattgtatccatgttgttcacctctctttacttatacttcatctatataaaaaaatttttattatgccaaaactaaaagataacatagtttggttcgaagtggaagatttgttatccacagaaatagaaattcgtcccttattactttaacttatccacatgtgaataacaattaattttatttcctgaacttcctttttatcaacaggatacacctaaaaagaaaaaacttaaacggcaaaaccttgatattactaggaaaagtagatttttcggatacaaaaaaaccgaaatccaatttttatcggacttcggttttatgctatcttttatgggaaataacgagatgacgattttcgccttcacccattgaatatgttttgatctggtggtttgcatatccagaaagagtatcgtgaataatttttctttcgctggacggcatgggctcaagctggatggattttttcgttttcaaaacctggtcagcaagcttgatggccagctggctcagtgtttcttttcttttcaaacgatagttttctgcatccaccgtcacatttttatattggcctggataacggttaagggcaagctgtgtcaaagtttcaagggcgtttaaggtttgtcctcttttcccaatcaacaatgctgccttttcacctgttatatgatatctcactgtctttttgctttcttgaacagtcacatcagacttcccggcaatggcttcggcaatcgtttgaagatataacttcgcttgctgaatcggatcaatcttttcaaccagctttacgatcgcaggctttttaccgaaaatgccgagaaaccctttgtttccctcttcaataacagtaatttctaccttatccttcgttaatcccagctcttgcaatccggactgtactgcttcatcgacatttcgccctgcagcagtcacattcctcactttttctttcctccggctttttgcggctcaggattttttttaatatcaggtcctttaatgaggaaagtttgcgcaatcataaacaagttaccaactacccaataaagagaaagagccgccgggaagttgatcgcaaatacgataatcataattggcataatccaaagcatcatcgccatttgcggattttgctgcgcattgccagccatcatcagtttttgctgaacaaatgtagcgacaccggcaacgataggaagaatatagtaaggatctttttctcctaagtcaaaccataagaagctatgctctgaaatcgcctgggttctcatgatcgcatgatagaatccaattaaaatcggcatctggatcaaaatcgggaaacatcccgccaatggattgacaccatgcttttggaataaagccattgtttcctgctgaagcttttgctgcgttttttgatcctttgagctgtatttttctttaagcttttgcatttccggctgtaaagcctgcatcgctttcgaacttctcagctgcttaatcatcagcggtaaaattaataaacgaattaaaatggtaactagaattattgaaagcccgtagttatctcccgtcaatttcgctacatacgtaatgagctcagacaatggatatactacgtacttgtcccagaaatgcggactatctgcagtgatcggctctttcacactcgagcatccagccaaaagcatgaatacgccaaccatacttaatagcaaccctattctccttttcaacaacatttcctcctataattaatctttacactcttttattgcaaagcatacttgtatgtattttagcatctttcagttttaaatggtgtctttttctgatcaaccagaaaggaagcgcttttaaaagttgtaagaaagcagtggtgatgcctactttgacgaagatttcttatataatgaagactttctgaatagatgctgcagactttttttcgtttcctcatatgtcagctggctcgccggttttctggcaataatgatgtaatccttttccttcagtctctctttctcctcaagaaaggcctgccgaatcaaacgtttgatccgatttcgcatcacagcattgccaatttttttgctgacggaaagcccgacacgcagttcatcattttcaggctgatcaagcgtatataagacaaactggcggtttgcaactgatgtcccatgtttaaacactttttgaaaatcttcatttttctttaaacgatttcgcttcttcaaatgactcactccgatactggctggcagaaacttttaaaatttattatgaacatgagatgcatctgaaccaggaagcatgccccggttcattacgcatcacatctatcttttcccataacgtgaaaaaagaccactgacattattcagtggcctaagctgataatacttttctgcctttgcggcgacggcgtgctaaaactagacgaccgttttttgaactcatacggcttctgaagccatgaactttgctgcgtttacggttattcggttggaatgttcttttcatttatgacacctccctcgaggaatagctgttaaagacagtcttacttattatatttgcgttacctattcattgtcaacttcactagtgcttttatttcttgcaaccataataggataccataccttttcaactttcgaaaccttattttttagattccttaattttacggaaaaaagacaaattcaaacaatttgcccctaaaatcacgcatgtggatatctttttcggctttttttagtatccacagaggttatcgacaacattttcacattaccaacccctgtggacaaggttttttcaacaggttgtccgctttgtggataagattgtgacaaccattgcaagctctcgtttattttggtattatatttgtgttttaactcttgattactaatcctacctttcctctttatccacaaagtgtggataagttgtggattgatttcacacagcttgtgtagaaggttgtccacaagttgtgaaatttgtcgaaaagctatttatctactatattatatgttttcaacatttaatgtgtacgaatggtaagcgccatttgctctttttttgtgttctataacagagaaagacgccattttctaagaaaaggagggacgtgccggaag

SEQ ID NO: 17 - DNA, 1547 bp, Bacillus amyloliquefaciens
tcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtctgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaacctttatggagccagccgccgaaggtgggacagatgattggggtgaagtcgtaacaaggtagccgtatcggaaggtgcggctggatcacctccttt

SEQ ID NO: 18 - DNA, 1547 bp, Bacillus amyloliquefaciens; identical to SEQ ID NO: 17

SEQ ID NO: 19 - DNA, 1547 bp, Bacillus subtilis
tcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgaggcacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctccttt

SEQ ID NO: 20 - DNA, 414 bp, Bacillus
ctcgcggacggacttgtcagcggagccgcacattctacagccgatacggtgcgccctgcactgcaaatcatcaaaacaaaagaaggcgtgaaaaaaacatcaggcgtcttcatcatggcccgcggtgacgagcagtatgtgttcgctgattgcgcgatcaacattgctcctgacagccaggaccttgccgaaatcgccattgaaagcgccaatacggctcaaatgtttgacattgacccgcgcgttgccatgctcagcttctctacaaaaggatcggcgaaatcagacgagacggacaaagtggctgaagccgtgaaaattgcgaaggaaaaagcgcctgagcttacgcttgacggcgaattccaattcgacgctgcatttgtgccgtctgtcgcggagaaaaaagcgccggac

SEQ ID NO: 21 - DNA, 399 bp, Bacillus
aatgtcgtccatctgtatgagcgggactgttccgttcagagacgccatcaaaaggtcattgaagtggcgccgagtgtatctttgcagcctgaattaagggacgaaatctgtgaagcggctgtggcgcttgcgaaaaatgtcggctatatcaacgcggggaccgtggaatttctcgtagcgggcggtgaattttactttattgaagtgaacccgcgcgtacaagtggagcatacgattacggaaatgataacgggggttgatatcgttcagacgcagattctcgtcgcgcagggccacggactgcacagccgcgccgtcaatatcccagagcagaaagacatttttacaaacgggtatgcgatacaatcacgtgtgaccactgaagatccgctgaatgac

SEQ ID NO: 22 - DNA, 384 bp, Bacillus
gagaagtttgactaccgtaaaggatataaattcagtacgtatgcgacttggtggatcagacaggcgattacacgcgccatcgctgaccaggcgagaacaatccgtatcccggttcacatggtggaaaccattaataaattaatccgggtgcagcgtcagcttcttcaggatcttggcagagagccgacaccggaagagattgctgaagacatggatcttacgcctgaaaaagtccgtgaaatattaaaaattgctcaagagccagtttctttagaaacaccgatcggtgaagaagacgactcacatctcggtgattttatcgaagaccaggaagcgacatctccgtcggatcatgcggcatatgagcttttaaaagaacagctg

SEQ ID NO: 23 - DNA, 420 bp, Bacillus
tctgctgttaaaggaactgacctgaaagtcggcgcccaaaacatgcattttgaagaaaacggtgcgttcacaggtgaaatcagcccggtcgctctgaaagaccttggcgtggattactgcgtcatcggccactctgagcgccgtgaaatgttcgctgaaactgatgaaacagttaacaaaaaagcgcatgccgctttcaaacacggcattgtgccgatcatttgcgtaggtgaaacgcttgaagagcgcgaagccggaaaaacaaatgatcttgttgccgatcaagtgaaaaaagggcttgcgggtctttctgaagagcaagttgctgcttccgttattgcgtacgagccaatctgggcaatcggaacaggcaaatcttctacagcgaaagatgcaaacgacgtctgcgcgcatatccgt

SEQ ID NO: 24 - DNA, 384 bp, Bacillus
tctggctggattgttgttgtatttggatggggattgggtgttgccatggcggcatacgcggttggcggcatcagcggtgcccatttgaatccggcgctaacgatagcgcttgcatttgtaggagattttccttggaaagaggttccggtttatattgcggcgcaaatgatcggagcgatcatcggtgcggtgattatttatctgcattacctcccgcactggaagtcaacggatgatcccgctgccaagctgggtgttttctcaacagggcccagcattccgcatacatttgcaaacgttttaagcgaagtgattgggacatttgtccttgtacttggaatcttggccattggggcaaatcaatttacagaaggacttaatcct

SEQ ID NO: 25 - DNA, 471 bp, Bacillus
aacattccgacgatttttgtcagcggtggaccgatggcggcaggaagaacaagtgacgggcgaaaaatctccctttcctcagtattcgaaggggtaggcgcctaccaagcagggaaaatcaacgaaaacgagcttcaagaactagagcagttcggatgcccaacgtgcggatcttgctcaggcatgtttacggcgaactcaatgaactgtctgtcagaagcacttggtcttgctttgccgggtaatggaaccattctggcgacatctccggaacgcaaagagtttgtaagaaaatcggctgcgcaattaatggaaacgattcgcaaagatatcaaaccgcgtgatatcgttacagtaaaagcgattgataacgcgtttgcactcgatatggcgctcggaggttctacaaataccgttcttcatacccttgcccttgcaaacgaagccggcgttgaatactctttagaacgc

SEQ ID NO: 26 - DNA, 414 bp, Bacillus
cttgcagacggacttgtaagcggagctgctcactcgacagctgacactgtacgcccggctcttcaaatcatcaaaacaaaagaaggcgtgaaaaagacttcaggcgtgttcatcatggctcgcggggaagagcaatacgtattcgcagattgcgcgatcaacattgcgcctgacagccaagaccttgccgagattgcgatcgaaagtgccaatacggcaaaaatgttcgacattgagcctcgcgtggcaatgctcagcttctctacaaaaggctcagcaaaatctgatgaaacagaaaaagtagcggatgcagtgaaaatcgcgaaagaaaaagcgcctgaactgacacttgacggcgaattccaattcgatgctgcatttgttccatctgtagctgagaaaaaagcgccggat

SEQ ID NO: 27 - DNA, 399 bp, Bacillus
attgcgcaagcagaacagcttcacggaaaagagctttcttacaacaacattaaagacgcggatgctgcagttcaaatcgttcgtgaattcactgaaccggctgctgttgctgtgaagcatatgaacccgtgcggcgtgggaacaggaaaaacgatcgcagaagcgtttgacagagcgtttgaagcggataaaacatctatcttcggcggcattatcgcgctgaaccgtgaagtggacaaggcaactgccgaagcgcttcacaacattttcttagaaatcatcattgcgccttcattcagccaagaagcgctcgacgtcctgactgcgaagaaaaatctccgtctgctgacgcttgacgtatccgccgctgttcaaaaggaaaaacagctgacatccgtt

SEQ ID NO: 28 - DNA, 399 bp, Bacillus
aatgtcgtccatctttttgagagggattgttccgttcaaagacgccatcaaaaggtcattgaagtggcgccgagtgtctcgctgtcacctgaattaagggatcaaatttgtgaggcggcagttgcgcttgctaaaaatgtaaactatataaatgcggggacggtagaattccttgttgcaaacaacgagttctactttattgaagtaaatcctcgcgtacaagttgaacacacgataacagaaatgattactggtgtcgatattgttcaaactcagatccttgttgcccaagggcacagccttcacagcaaaaaagtaaatattcctgagcaaaaggacatttttacaatcggctatgccattcagtcacgggttacgactgaggatccgcaaaatgat

SEQ ID NO: 29 - DNA, 384 bp, Bacillus
gaaaaatttgattatcgcaaaggttataaattcagtacgtatgctacgtggtggatcagacaggcgattacacgcgccattgccgatcaggcgagaacgatccggattcccgttcatatggttgaaaccattaataaattaatccgtgtgcagcgtcaattactgcaagacttaggcagagaaccaacacctgaagaaattgcggaagatatggatttaacgcctgaaaaagtacgcgaaatcttaaagattgctcaagagccggtatctctggaaacaccgatcggtgaagaggatgactcgcaccttggtgatttcattgaagaccaagaagcaacttcaccttctgaccacgccgcatacgagctattgaaagagcagctg

SEQ ID NO: 30 - DNA, 420 bp, Bacillus
tctgctgtgaaaggcactgacctaaaagtcggcgctcaaaacatgcacttcgaagaaagcggcgcgttcacaggcgaaatcagcccggttgctctgaaagaccttggcgttgactactgcgtcatcggccactctgagcgccgtgaaatgttcgctgaaactgatgaaacagttaacaaaaaagcacacgcagctttcaaacacggcattgtgccgatcatctgtgtaggtgaaacgcttgaagagcgtgaagccggcaaaacaaatgatcttgttgctgaccaagtgaaaaaaggccttgctggtctttctgaagaacaagttgctgcttctgttattgcgtatgagccaatctgggcaatcggaacaggcaaatcttctacagcgaaagatgcgaatgacgtgtgtgcgcatatccgt

SEQ ID NO: 31 - DNA, 471 bp, Bacillus
aatattccgaccatttttgtcagcggggggccgatggcagccggccgcacaagcgacggccgcaaaatttcgctttcttcagtatttgaaggcgtcggcgcatatcaagccgggaaaatcggtgaaagcgacctgcaggagctggaacagttcggctgcccgacgtgcggatcttgttcaggcatgtttacggcaaactccatgaactgtctgtctgaagcgctcggtctggcgcttccgggaaacggaacaattctggcaacttcaccggagagaagagagtttgtgagaaaatcagcggcccaattgatggagaccatcaaaaaagacattaagccgcgcgatattgtcaccgaaaaagcgattgacaacgcctttgcgttagacatggctctcggcggctcaaccaacacagtgctacatacgcttgcgcttgccaatgaagctggggttgagtactctttagaacgc

SEQ ID NO: 32 - DNA, 414 bp, Bacillus; identical to SEQ ID NO: 20

SEQ ID NO: 33 - DNA, 399 bp, Bacillus; identical to SEQ ID NO: 21

SEQ ID NO: 34 - DNA, 384 bp, Bacillus; identical to SEQ ID NO: 22

SEQ ID NO: 35 - DNA, 420 bp, Bacillus; identical to SEQ ID NO: 23

SEQ ID NO: 36 - DNA, 384 bp, Bacillus
tccggatggattgttattgtattcggctggggattgggagtagccatggcggcatatgccgtcggcagcatcagcggcgctcacttgaatccggctttaacgataggccttgcgcttgaaggcagctttccttggaaagacgtccctgtttatattgcgggacagatgatcggagcaatgatcggtgcggttgttgtgtaccttcattatctgccgcattggaaggcgacggatgatccggccgctaaactgggcgttttctcgaccggcccgagtattccccatacatttgggaatatgataagtgaagtcattggtacgtttgtgcttgtgctcggcattttggcaatcggagcgaatgaatttacaaaagggctgaacccg

SEQ ID NO: 37 - DNA, 399 bp, Bacillus
atcgcagcggcaaaacagcttcacggcaaagagctttcttataacaatattaaggacgcggatgcggctgttcaaatcgtccgggaatttacagaacccgcagctgttgccgttaaacatatgaatccatgcggagtcggtacgggagcttcaattgaggaagcattcaataaagcgtatgaagctgataaaacctccattttcggcggcatcatcgcgctgaaccgtgaagttgatcaggcaacggctgaagcccttcacggcatctttttagaaatcattatcgccccttctttcagtgaagaagcgctgaacgtgctgacggcgaagaaaaaccttcgtctgctcacgcttgacgtgaccgcatcaggaaagaaagaaaaacagctgacttccgta

SEQ ID NO: 38 - DNA, 384 bp, Bacillus; identical to SEQ ID NO: 36

SEQ ID NO: 39 - DNA, 399 bp, Bacillus; identical to SEQ ID NO: 37

SEQ ID NO: 40 - protein, 60 aa, Bacillus
MNEKMYRFCTLTWECGLCPTHTCWCAGDLREELEEISLSEFSGGGGAEQRGISQGNDGKL

SEQ ID NO: 41 - protein, 97 aa, Bacillus
VFEMKFKKVLTGSALSLALLMSAAPAFAASPTASPSVENSPISTKADAGINAIKPVPSPNGIFAASFELNGTTWIFKYKYYDSSKGYWVGIYESVDK

SEQ ID NO: 42 - protein, 76 aa, Bacillus
VAAAHAFSANAELASTLGISTAAAKKAIDIIDAASTIASIISLIGIVTGAGAISYAIVATAKTMIKKYGKKYAAAW

SEQ ID NO: 43 - protein, 60 aa, Bacillus
MNEKMYRFAGDLREELEEISLSEFSGGGGAEQRGISQGNDGKLCTLTWECGLCPTHTCWC

SEQ ID NO: 44 - protein, 112 aa, Bacillus
MMNLVKSNKKSFILFGVALAAATLVYALLLTGTELNVAAAHAFSANAELASTLGISTAAAKKAIDIIDAASTIASIISLIGIVTGAGAISYAIVATAKTMIKKYGKKYAAAW

SEQ ID NO: 45 - protein, 94 aa, Bacillus
MKFKKVLTGSALSLALLMSAAPAFAASPTASPSVENSPISTKADAGINAIKPVPSPNGIFAASFELNGTTWIFKYKYYDSSKGYWVGIYESVDK

SEQ ID NO: 46 - protein, 50 aa, Bacillus
LKLPVQQVYSVYGGKDLPKGHSHSTMPFLSKLQFLTKIYLLDIHTQPFFI

SEQ ID NO: 47 - protein, 563 aa, Bacillus
MGYQALYRVFRPQQFEDVVGQEHITKTLQNALLQKKFSHAYLFSGPRGTGKTSAAKIFAKAVNCEHAPVEEPCNECAACKGITNGSISDVIEIDAASNNGVDEIRDIRDKVKFAPSAVTYKVYIIDEVHMLSIGAFNALLKTLEEPPAHCIFILATTEPHKIPLTIISRCQRFDFKRITSKAIVGRMKTIVDAEQLKVEEGALDIIASAADGGMRDALSLLDQAVSFSGEELSVDDALLITGAVSQHYIGKLASALHRKQVSEALETLNELLQQGKDAAKLIEDMIFYFRDMLLYQAAPGLEGVLEKVKVDETFRNLSGDIPAPALYEMIDILNKSHQEMKWTNHPRIFFEVAVVKICQTAQQSAGDIPEVGMLMNKIQQLEQEVERLKTSGVKVQMESAPKEAPRPQKGGKSHYKAPVGRIHEILKEATRPDLEQLKSSWGKLLAHLKQQNKVSHAALLNDSEPVAAAQKAFVLKFKYEIHCKMVAEDNNGVRTNLEQILESMLGKRMDLIGVPEAQWGKIREEFLNDHQQESEGSNEPAEEDPLIAEAKKLVGADLIEIKD

SEQ ID NO: 48 - DNA, 1692 bp, Bacillus
gtgggttaccaagctttatatcgagtatttaggcctcagcagtttgaagatgtggtcggacaggaacacattacgaaaacgctgcaaaatgcccttttgcaaaagaaattttctcatgcatatctgttttctggaccgcggggaacgggaaaaaccagtgcagctaaaatatttgcgaaagcagtcaactgtgagcacgcccctgtagaagaaccgtgcaatgagtgcgcggcatgcaaggggatcacaaatggctctatatcagatgtgattgaaatagatgcggcgtcgaataacggcgtagacgaaatccgcgacatccgtgacaaagtaaaatttgccccgtcggccgttacttacaaggtatatattatagatgaggtgcatatgctctctatcggcgcattcaatgcgcttctgaaaacgctggaagaaccgccggcacattgcattttcatattagctacgactgagcctcataagattcctttaaccattatctccagatgtcagcgttttgacttcaaacggattacatccaaagcaattgtcggacgaatgaagacaatcgtcgatgcagagcagctgaaggtggaagaaggagcccttgatatcatagcgagtgctgcggacggaggaatgagggacgcgctgagcctgctcgatcaagctgtatcattcagcggcgaggagctgtcggtggatgacgctttgctcattaccggagccgtttctcagcactatattggaaaactggcatctgctcttcaccgcaaacaggtttccgaggcattggaaacactgaatgaattgctccagcaggggaaagatgcggccaaactgattgaagatatgattttctatttcagggatatgctcttgtaccaggccgctcccggtttagaaggagtcctggagaaggtgaaggtcgatgaaacgtttcggaatctgagcggtgacataccggcccccgctttatatgagatgattgatatcctgaataaaagccatcaggaaatgaagtggacgaaccacccaagaatcttttttgaagtggctgtcgtgaaaatatgccaaacggcacagcaatccgccggagacatccctgaggtcggcatgctgatgaataagatccagcagcttgagcaggaagtagaaaggctgaaaacctccggtgtgaaggttcagatggaaagcgctccgaaagaagctccgcgtcctcaaaaaggcggaaaaagccattataaagccccggtcggaagaattcatgagatattgaaggaagccacaagacctgatcttgaacagcttaaaagcagctggggcaagctgctggcacacctgaaacagcagaataaggtgtctcatgcggctcttttgaatgacagtgaaccggtggccgctgctcaaaaggcatttgtgcttaaatttaaatacgaaatccattgtaaaatggttgcagaagacaataacggagtccgtacgaatcttgaacagattctcgaatcaatgctcgggaaaagaatggatttgattggcgttccggaagcacaatggggtaaaataagagaagaatttttaaatgatcaccagcaggaaagtgaaggatcaaacgaaccggctgaagaagatccgctgattgcagaggcgaaaaaacttgtcggagcggatttaatcgaaataaaagactaa

SEQ ID NO: 49 - protein, 328 aa, Bacillus
MGYQALYRVFRPQQFEDVVGQEHITKTLQNALLQKKFSHAYLFSGPRGTGKTSAAKIFAKAVNCEHAPVEEPCNECAACKGITNGSISDVIEIDAASNNGVDEIRDIRDKVKFAPSAVTYKVYIIDEVHMLSIGAFNALLKTLEEPPAHCIFILATTEPHKIPLTIISRCQRFDFKRITSKAIVGRMKTIVDAEQLKVEEGALDIIASAADGGMRDALSLLDQAVSFSGEELSVDDALLITGAVSQHYIGKLASALHRKQVSEALETLNELLQQGKDAAKLIEDMIFYFRDMLLYQAAPGLEGVLEKVKVDETFRNLSGDIPAPLYMR

SEQ ID NO: 50 - DNA, 987 bp, Bacillus
gtgggttaccaagctttatatcgagtatttaggcctcagcagtttgaagatgtggtcggacaggaacacattacgaaaacgctgcaaaatgcccttttgcaaaagaaattttctcatgcatatctgttttctggaccgcggggaacgggaaaaaccagtgcagctaaaatatttgcgaaagcagtcaactgtgagcacgcccctgtagaagaaccgtgcaatgagtgcgcggcatgcaaggggatcacaaatggctctatatcagatgtgattgaaatagatgcggcgtcgaataacggcgtagacgaaatccgcgacatccgtgacaaagtaaaatttgccccgtcggccgttacttacaaggtatatattatagatgaggtgcatatgctctctatcggcgcattcaatgcgcttctgaaaacgctggaagaaccgccggcacattgcattttcatattagctacgactgagcctcataagattcctttaaccattatctccagatgtcagcgttttgacttcaaacggattacatccaaagcaattgtcggacgaatgaagacaatcgtcgatgcagagcagctgaaggtggaagaaggagcccttgatatcatagcgagtgctgcggacggaggaatgagggacgcgctgagcctgctcgatcaagctgtatcattcagcggcgaggagctgtcggtggatgacgctttgctcattaccggagccgtttctcagcactatattggaaaactggcatctgctcttcaccgcaaacaggtttccgaggcattggaaacactgaatgaattgctccagcaggggaaagatgcggccaaactgattgaagatatgattttctatttcagggatatgctcttgtaccaggccgctcccggtttagaaggagtcctggagaaggtgaaggtcgatgaaacgtttcggaatctgagcggtgacataccggccccgctttatatgagatga

SEQ ID NO: 51 - protein, 258 aa, Bacillus
MLQPEKVRLEEEIEKVLSLKPDLIVTAAFGQILPKQLLDGPKYGCINVHASLLPELRGGAPIHYSILQGKKKTGVTIMYMVEKLDAGDMISKIEVEIHETDNVGTLHDKLSIAGAKLLSETVPNVISGNIKPIKQDESKATYAPNIKREQERIDWAKPGEEIYNQIRGLNPWPVAYTTLNGQTIKVWASEKVAAKTDAAPGTVIRTEQNGIVVASGNSTALLITELQPAGKKRMKGEDFVRGKNVQPGDVLGAANEEN

SEQ ID NO: 52 - DNA, 777 bp, Bacillus
gtgcttcagcccgaaaaagtaaggctcgaagaagaaatagaaaaagtgctaagcctgaagccggacctgattgttacggcggcattcggacagatcctgcccaagcagctgctggacggtccgaaatacggctgtatcaacgtacacgcgtcactattgcctgaattaagaggcggagcgccgatacattattcgattctccaaggcaagaagaaaacaggcgtgacgatcatgtatatggttgaaaagcttgatgcgggcgatatgatttctaaaatcgaagtggaaattcatgaaacggataacgtcggcacgctgcacgacaaattaagcatagcgggggcaaagcttttgtcagagaccgtcccgaacgtcatctccggaaatattaaaccgatcaaacaggacgaatcaaaagcgacttacgcgcctaacattaagcgtgagcaggagcggattgattgggcaaagcccggagaagagatctacaaccagatcagaggtttaaacccttggcctgtcgcctatacaactttgaacggtcaaactattaaagtatgggcttctgaaaaagttgcggcaaaaactgatgctgcgcccggaacagtcatccgcacggagcaaaacggcattgtcgtcgcatcaggaaacagcaccgcccttttaatcactgagctgcagccggcggggaaaaaacggatgaagggcgaagattttgtaagaggcaaaaatgtgcagcccggtgacgtgttaggagcagcaaatgaagaaaattaa

SEQ ID NO: 53 - protein, 311 aa, Bacillus
MGTPDFSVPVLRTLIEDGYEVVGVVTQPDRPKGRKKIMTPPPVKAEAERHGIPVLQPEKVRLEEEIEKVLSLKPDLIVTAAFGQILPKQLLDGPKYGCINVHASLLPELRGGAPIHYSILQGKKKTGVTIMYMVEKLDAGDMISKIEVEIHETDNVGTLHDKLSIAGAKLLSETVPNVISGNIKPIKQDESKATYAPNIKREQERIDWAKPGEEIYNQIRGLNPWPVAYTTLNGQTIKVWASEKVAAKTDAAPGTVIRTEQNGIVVASGNSTALLITELQPAGKKRMKGEDFVRGKNVQPGDVLGAANEEN

SEQ ID NO: 54 - DNA, 936 bp, Bacillus
atgggaacgcccgacttttcagttcccgtcctgcgcacgcttattgaagacggatatgaagtggttggtgtcgttacgcagcctgaccgcccgaaaggcagaaaaaaaatcatgacgccccctcctgtaaaggctgaagctgaacgtcacggcattcccgtgcttcagcccgaaaaagtaaggctcgaagaagaaatagaaaaagtgctaagcctgaagccggacctgattgttacggcggcattcggacagatcctgcccaagcagctgctggacggtccgaaatacggctgtatcaacgtacacgcgtcactattgcctgaattaagaggcggagcgccgatacattattcgattctccaaggcaagaagaaaacaggcgtgacgatcatgtatatggttgaaaagcttgatgcgggcgatatgatttctaaaatcgaagtggaaattcatgaaacggataacgtcggcacgctgcacgacaaattaagcatagcgggggcaaagcttttgtcagagaccgtcccgaacgtcatctccggaaatattaaaccgatcaaacaggacgaatcaaaagcgacttacgcgcctaacattaagcgtgagcaggagcggattgattgggcaaagcccggagaagagatctacaaccagatcagaggtttaaacccttggcctgtcgcctatacaactttgaacggtcaaactattaaagtatgggcttctgaaaaagttgcggcaaaaactgatgctgcgcccggaacagtcatccgcacggagcaaaacggcattgtcgtcgcatcaggaaacagcaccgcccttttaatcactgagctgcagccggcggggaaaaaacggatgaagggcgaagattttgtaagaggcaaaaatgtgcagcccggtgacgtgttaggagcagcaaatgaagaaaattaa

SEQ ID NO: 55 - protein, 442 aa, Bacillus
MDLWNQALAQIEKKLSKPSFETWMKSTKAHSLQGDTLTITAPNEFARDWLESRYLHLIADTIYELTGEELSVKFVIPQNQDEEDFLPKPQVKKAAKEEPSDFPQSMLNPKYTFDTFVIGSGNRFAHAASLAVAEAPAKAYNPLFIYGGVGLGKTHLMHAIGHYVIDHNPSAKVVYLSSEKFTNEFINSIRDNKAVDFRNRYRNVDVLLIDDIQFLAGKEQTQEEFFHTFNTLHEESKQIVISSDRPPKEIPTLEDRLRSRFEWGLITDITPPDLETRIAILRKKAKAEGLDIPNEVMLYIANQIDSNIRELEGALIRVVAYSSLINKDINADLAAEALKDIIPSSKPKVITIKEIQRIVGQQFNIKLEDFKAKKRTKSVAFPRQIAMYLSREMTDSSLPKIGEEFGGRDHTTVIHAHEKISKLLIDDEQLQQQVKEIKELLK

SEQ ID NO: 56 - DNA, 1329 bp, Bacillus
ttggatctttggaatcaagctctagctcaaattgagaaaaagctaagcaaaccgagtttcgaaacttggatgaagtcgacgaaagcccattcgctgcaaggagataccttaaccatcaccgctcccaatgaatttgccagagactggctggagtccaggtacttacatctcattgcagataccatatatgaattaaccggggaagaattgagcgtcaaatttgtcattcctcaaaatcaggacgaagaagactttttgccgaaaccgcaagtgaaaaaagcggcaaaagaggaaccgtctgattttccccaaagcatgctcaacccgaaatatacattcgacacattcgtcatcggatcgggaaaccgattcgcccatgcagcatcactggctgtggcggaagcacccgctaaagcgtacaaccctttatttatatacgggggagtcggtttaggaaaaacccacttaatgcacgcgatcggccattatgtcattgatcataatccttcagccaaagtggtgtacctgtcttctgaaaaattcacaaatgaattcatcaactcaatccgcgataataaagccgttgatttccgcaaccgctaccggaacgttgatgtacttttgatagatgatattcaatttttagccggaaaagaacaaacacaggaagagtttttccatacattcaacacacttcatgaagaaagcaaacaaatcgtgatttccagtgacagaccgccgaaagagatcccgacccttgaagaccgcctgcgttcgcggttcgaatggggattgattacagacatcacaccgccggatctggaaacgcggattgccattctgagaaagaaagcgaaggcggagggccttgatattccgaacgaggtcatgctttacatcgccaatcagattgacagcaacatccgcgaactggaaggggcattaatccgggttgtcgcctattcatccttaatcaataaagacattaacgcagacctggctgcagaagcattgaaagatattattccgtcttctaagccgaaggtcattacgataaaagagattcagcggattgtcggacagcagttcaacattaagcttgaagatttcaaagcgaaaaagcgtacgaaatcagtggctttcccaagacaaattgcgatgtatctttcaagagaaatgacggattcttctttgcctaaaatcggggaagaatttggcgggagagaccatacaaccgtcattcacgcccacgaaaagatttcaaaactgctgattgatgacgagcagcttcagcagcaggtgaaagaaataaaagaactgcttaaataa

SEQ ID NO: 57 - protein, 446 aa, Bacillus
MENILDLWNQALAQIEKKLSKPSFETWMKSTKAHSLQGDTLTITAPNEFARDWLESRYLHLIADTIYELTGEELSVKFVIPQNQDEEDFLPKPQVKKAAKEEPSDFPQSMLNPKYTFDTFVIGSGNRFAHAASLAVAEAPAKAYNPLFIYGGVGLGKTHLMHAIGHYVIDHNPSAKVVYLSSEKFTNEFINSIRDNKAVDFRNRYRNVDVLLIDDIQFLAGKEQTQEEFFHTFNTLHEESKQIVISSDRPPKEIPTLEDRLRSRFEWGLITDITPPDLETRIAILRKKAKAEGLDIPNEVMLYIANQIDSNIRELEGALIRVVAYSSLINKDINADLAAEALKDIIPSSKPKVITIKEIQRIVGQQFNIKLEDFKAKKRTKSVAFPRQIAMYLSREMTDSSLPKIGEEFGGRDHTTVIHAHEKISKLLIDDEQLQQQVKEIKELLK

SEQ ID NO: 58 - DNA, 1341 bp, Bacillus
atggagaatatattggatctttggaatcaagctctagctcaaattgagaaaaagctaagcaaaccgagtttcgaaacttggatgaagtcgacgaaagcccattcgctgcaaggagataccttaaccatcaccgctcccaatgaatttgccagagactggctggagtccaggtacttacatctcattgcagataccatatatgaattaaccggggaagaattgagcgtcaaatttgtcattcctcaaaatcaggacgaagaagactttttgccgaaaccgcaagtgaaaaaagcggcaaaagaggaaccgtctgattttccccaaagcatgctcaacccgaaatatacattcgacacattcgtcatcggatcgggaaaccgattcgcccatgcagcatcactggctgtggcggaagcacccgctaaagcgtacaaccctttatttatatacgggggagtcggtttaggaaaaacccacttaatgcacgcgatcggccattatgtcattgatcataatccttcagccaaagtggtgtacctgtcttctgaaaaattcacaaatgaattcatcaactcaatccgcgataataaagccgttgatttccgcaaccgctaccggaacgttgatgtacttttgatagatgatattcaatttttagccggaaaagaacaaacacaggaagagtttttccatacattcaacacacttcatgaagaaagcaaacaaatcgtgatttccagtgacagaccgccgaaagagatcccgacccttgaagaccgcctgcgttcgcggttcgaatggggattgattacagacatcacaccgccggatctggaaacgcggattgccattctgagaaagaaagcgaaggcggagggccttgatattccgaacgaggtcatgctttacatcgccaatcagattgacagcaacatccgcgaactggaaggggcattaatccgggttgtcgcctattcatccttaatcaataaagacattaacgcagacctggctgcagaagcattgaaagatattattccgtcttctaagccgaaggtcattacgataaaagagattcagcggattgtcggacagcagttcaacattaagcttgaagatttcaaagcgaaaaagcgtacgaaatcagtggctttcccaagacaaattgcgatgtatctttcaagagaaatgacggattcttctttgcctaaaatcggggaagaatttggcgggagagaccatacaaccgtcattcacgcccacgaaaagatttcaaaactgctgattgatgacgagcagcttcagcagcaggtgaaagaaataaaagaactgcttaaataa

SEQ ID NO: 59 - DNA, 378 bp, Bacillus amyloliquefaciens
gtgtcacagcctaatatgcccaatatcacccctgtcgttacactttccagagacgataccattaaccttcttctttcgtcaattgctatggaagagctgggaatggcacatattctgaatgcggaaggggaaaaaatccaatacgcgctcggaacgattcccggattaacaggacccccgtcaagtcttgcggatattcttaacctgaatgagagcgtccgggatacgcttgacagcttaatgaaacaggagctccttctcggttcaaaattggacagtatctcaaatatccctacattggcgggaccgacgggggccacggggccgacggggccacgggtgcgggtcttcaagggattgttgcttttaatccgctga

SEQ ID NO: 60 - protein, 125 aa, Bacillus amyloliquefaciens
MSQPNMPNITPVVTLSRDDTINLLLSSIAMEELGMAHILNAEGEKIQYALGTIPGLTGPPSSLADILNLNESVRDTLDSLMKQELLLGSKLDSISNIPTLAGPTGATGPTGPRVRVFKGLLLLIR

SEQ ID NO: 61 - DNA, 240 bp, Bacillus amyloliquefaciens
atgcattacataacggcatgcttaaaaatcatcagtgataaagaccttaatgaaataatgaaggaattcaaaaacttgaggaagaaacgaacaaagaagaaggctgtattcagttccatgctcatccgcttgaaccatcagaacgcaaaattatgctttgggagatttgggaaaacgaagaagctgttaaagtccattttacgaaaaagcacacaaaagacgttcaaaaacaagaattaa

SEQ ID NO: 62 - protein, 79 aa, Bacillus amyloliquefaciens
MHYITACLKIISDKDLNEIMKEFKNLRKKRTKKKAVFSSMLIRLNHQNAKLCFGRFGKTKKLLKSILRKSTQKTFKNKN

SEQ ID NO: 63 - DNA, 1212 bp, Bacillus amyloliquefaciens
atgaatgactgtgtcaaaacattcggagaacttccggccgaactttattcctttgcgggaggaaaaggaagcattctctctaaaatgtatcaaagcgggtatcctgtgcctgaagggtttgtgattttgccgtcagcctttcaggacggacagctccgccatcaggcgagagaggctgttgatcaatatgtgaattccatccgcagccgccatgcatctgcgttgtttgccgtacgctcatccgcgctgagcgaggattccgctcaggcttcctttgccggagaattcgatacggtgttgaatgtcagaacagatcaagacatgtccagggcgattgatgaagtccgccggtcggtacagtcagaaagagtaaaagcgtacagcgccgttcagggaatggaagatgagcatgaaatcgcaatcgtcatccagctgatgataccgtctgagatatccggagtgctgtttaccgcagatccgattacggggagcaggcgggagatgacaggcaattacgtctacggtctcggggagcagctcgtttccggggaagccgatgcctattcttttaaactggcacggcccaagaaaaaatatgacggccccggggaatttcgcaaatatgcgtcaaagctctataaactggcgaaaaagctggaaaaagatcttggagggccgcaggatattgaatgggccgccgcgggcgggacattgtatattcttcaatcccgcccgattacgaccttacaagccggaaatctggaaacctatgaatggaacgattctttcagcggtgattttttatggacaaacacaaatataggagaagcgattcccgatgtgatgacgccgctgacatggtcgctcctccggaatctggatgaagagtcgggcatcattccgggctattatgtctggtccggcaatatttgcggcagagcctataacaatatgagccagcctctttccgttctcgccgctttcggtctgaatccgaaaggcggaaaaattggaaaaatgatgagcgatacattgggagaaatcccggcggaaatgaagatacctttatatccgttctcaaagtatgaattattgaagatcatcccgaaaaaactgaaaccgtatctgtcgaaaatgaagcaagcgaaaaaaacatgtcctcctacttggacgaatcaccggagtggtgccggaatattgaggaaaagctga

SEQ ID NO: 64 - protein, 403 aa, Bacillus amyloliquefaciens
MNDCVKTFGELPAELYSFAGGKGSILSKMYQSGYPVPEGFVILPSAFQDGQLRHQAREAVDQYVNSIRSRHASALFAVRSSALSEDSAQASFAGEFDTVLNVRTDQDMSRAIDEVRRSVQSERVKAYSAVQGMEDEHEIAIVIQLMIPSEISGVLFTADPITGSRREMTGNYVYGLGEQLVSGEADAYSFKLARPKKKYDGPGEFRKYASKLYKLAKKLEKDLGGPQDIEWAAAGGTLYILQSRPITTLQAGNLETYEWNDSFSGDFLWTNTNIGEAIPDVMTPLTWSLLRNLDEESGIIPGYYVWSGNICGRAYNNMSQPLSVLAAFGLNPKGGKIGKMMSDTLGEIPAEMKIPLYPFSKYELLKIIPKKLKPYLSKMKQAKKTCPPTWTNHRSGAGILRKS

SEQ ID NO: 65 - DNA, 789 bp, Bacillus amyloliquefaciens
atgtctaagcaaggaaacttccagaaaactatgtcactttttgatcttattttaatcggcatgggagccatattcggttcggcatggctgtttgccgtcagtaacgtcgcctctaaagcgggcccgtcaggcgttttttcctggctgatcggcgggggaatcatcttattgatcggcttggtttatgcggaactgggcgccgcgctgccgcggaccgggggaattatccggtatcccgtatattcacacggacacctggtcggatatttaatttcctttgtcaccattgtggcatacacgagtcttatttctatagaagtaacggcggtccgccaatacgtggcgtattggtttcccggtttgaccgtaaaaggctctgattctccgacaattgccggatggatattgcaatttgcgctgctctgcctgttcttcctcctcaattactggagtgtcaaaacctttgcgaaagcaaacttcattatttcgatttttaaatatgtcgtaccgattacggtaattgttgtactgatttttcattttcacccgggcaatatgaccgttcacggattcgcgccttttggtttcaccggaattcaggccgcgatttccacaggcggcgtcatgtttgcataccttgggctgcatccgattgtggctgtcgcgagtgaagtgcagaatccgaagcggaacattccgattgcattgattgtttgtattatcgtttctactattatttataccgtgctgcagctcacttttatcggggcgatcccggggataccctga

SEQ ID NO: 66 - protein, 262 aa, Bacillus amyloliquefaciens
MSKQGNFQKTMSLFDLILIGMGAIFGSAWLFAVSNVASKAGPSGVFSWLIGGGIILLIGLVYAELGAALPRTGGIIRYPVYSHGHLVGYLISFVTIVAYTSLISIEVTAVRQYVAYWFPGLTVKGSDSPTIAGWILQFALLCLFFLLNYWSVKTFAKANFIISIFKYVVPITVIVVLIFHFHPGNMTVHGFAPFGFTGIQAAISTGGVMFAYLGLHPIVAVASEVQNPKRNIPIALIVCIIVSTIIYTVLQLTFIGAIPGIP

SEQ ID NO: 67 - DNA, 702 bp, Bacillus amyloliquefaciens
atgagaagtttttttgtcacaggaacagataccggcgtcggaaaaaccatcgtttcttgcggacttgccgcggcattcaggcagaaacaggcggatatcggagtgtttaaaccgtttttaagcggcgtgccgcggactcatccggaaagtgacacctcgctgttgaaaaacatgtcacaaaccgcactgtctcatgaagaaatcacgccatttgaatggaaagagccgcttgcgccgtacacggccgccatgcttgaggggaaatccgtgagcatggatgaagtcatggcccactggagtaagatcaaaaatcgtcatgagtgtttcatcgtcgagggggcaggcggcatttccgttccgcttggtgaaaattacttagtcagtgatttgataaaagccttggaattaccggcagtgattgtcgccaggcctgatctcggaaccatcaaccacacatatttaaccgttgaatatgcgaaaaacatgggaatagaggttctcggtattattatcaacggcgtaaagagccggccggggctggacgagaagacaaacccgagcatgattgaaacattatgcaaagttccgattttgggaatcacaccgaagctggatcacgtttcaccggaaaacattcaacacatgattgagaaacatatagatgtttcctctttcatgaatctgacacaaatggggagataa

SEQ ID NO: 68 - protein, 233 aa, Bacillus amyloliquefaciens
MRSFFVTGTDTGVGKTIVSCGLAAAFRQKQADIGVFKPFLSGVPRTHPESDTSLLKNMSQTALSHEEITPFEWKEPLAPYTAAMLEGKSVSMDEVMAHWSKIKNRHECFIVEGAGGISVPLGENYLVSDLIKALELPAVIVARPDLGTINHTYLTVEYAKNMGIEVLGIIINGVKSRPGLDEKTNPSMIETLCKVPILGITPKLDHVSPENIQHMIEKHIDVSSFMNLTQMGR

SEQ ID NO: 69 - DNA, 807 bp, Bacillus amyloliquefaciens
atgagcgctccagaagaaaaaaagatgagaaagcttcctaagtacatacaaatcattcaatttataaaagagaaaataggaaatggagaatggccgatcggaagtaagattccaagccagcgcacgcttgccaaacactttgaggtgaacaggagcacagtcattacagctttagaggaattgacggcggatggattaatcgaaggcagaatgggcaaagggacagttgttacgaacaatacatggacacttttggctaagaattccgctcccgattgggatcagtatgtaacctccggaattcagcagccaagccaaaaaatcgttcaagagatcaataaatcagaatcaaattctgatcttatacagctcagtaaaggagaactttcacatgagatttttcctttagctgttatgaaagagatcatgggaaaggtatcccaaaacatagaggcattcggatatgaggaaccaaaaggatatttgcctttgagagaggcattaagcggctatttaagaacaatcggcattcaagcttctccttcttccattcttattgtttcgggcgcactgcaagccttacagcttatatcaatggggcttttacaaaggggatcgaccgtttatcttgatcagccttcctatctttattcattacacgtatttcaatcagccggtatgaagctgactggagttcctatggatcatgatggacttttgccggaacatatccgcatggcaaggggagaacggggagggctatcttatatacaaatccttgttttcataatccgacaggtattttaa

SEQ ID NO: 70 - protein, 268 aa, Bacillus amyloliquefaciens
MSAPEEKKMRKLPKYIQIIQFIKEKIGNGEWPIGSKIPSQRTLAKHFEVNRSTVITALEELTADGLIEGRMGKGTVVTNNTWTLLAKNSAPDWDQYVTSGIQQPSQKIVQEINKSESNSDLIQLSKGELSHEIFPLAVMKEIMGKVSQNIEAFGYEEPKGYLPLREALSGYLRTIGIQASPSSILIVSGALQALQLISMGLLQRGSTVYLDQPSYLYSLHVFQSAGMKLTGVPMDHDGLLPEHIRMARGERGGLSYIQILVFIIRQVF

SEQ ID NO: 71 - DNA, 411 bp, Bacillus amyloliquefaciens
atgaacagacaagaattgattgcagaagcattaaaagcacgggacacagcgtatgtgccgtattcaaatttcagagtgggagccgctcttcttaccaaagacggaaaagtgtacagaggctgcaacattgaaaatgcggcatacagcatgtgcaactgtgctgaacgcacggcgatattcaaagctgtttccgagggggatacggaatttgcgatgctcgccgtggctgcggatactccgggaccggtttcgccgtgcggagcctgcagacaagtaatttccgagctgtgctcaaaggatatgcttgttattctgaccaacttacaaggacaaataaaagaaatgactgcggaagaattattgccgggcgcattttcatcggaggatttacatgacgaacgaaagctttaa

SEQ ID NO: 72 - protein, 136 aa, Bacillus amyloliquefaciens
MNRQELIAEALKARDTAYVPYSNFRVGAALLTKDGKVYRGCNIENAAYSMCNCAERTAIFKAVSEGDTEFAMLAVAADTPGPVSPCGACRQVISELCSKDMLVILTNLQGQIKEMTAEELLPGAFSSEDLHDERKL

SEQ ID NO: 73 - DNA, 348 bp, Bacillus amyloliquefaciens
atggaaaaacaaaccctcagccatccgattggagagtatcagccggctgaatcgatttcggccggacagaaacaagaatggatcaatgcgctggaacacgctccggctaaactgaaccaagctgtcagagcgatgtcggccagtcagcttgatacgccgtaccgcgaagggggatggactgtccgccaagtggttcaccatctggcggacagccacatgaacggctatacccggtttaaattgagcttaacggagaatgaaccggaaatccgtcctatgatgaaaaaggctgggccgctcttcatgattccaaaaccgccgcttgcggggatgcgcttgagctgttaa

SEQ ID NO: 74 - protein, 115 aa, Bacillus amyloliquefaciens
MEKQTLSHPIGEYQPAESISAGQKQEWINALEHAPAKLNQAVRAMSASQLDTPYREGGWTVRQVVHHLADSHMNGYTRFKLSLTENEPEIRPMMKKAGPLFMIPKPPLAGMRLSC

SEQ ID NO: 75 - DNA, 936 bp, Bacillus amyloliquefaciens
atgcttttccggcagcattttaaacctgtcgatattcacggtcatctgccgtacagccttaatttcggcaaaaacgataagacattttccgattataaccgggagcggtcggaaagaatgaatctcacttgggattttcctgatccgcatgatgttgatggcgatgacggcgaaatcgctttgatgacaagatgggagaaagaattagataagtacggcattgacgtgctgaattttttaacagcagagagcaatgaccggatggcggcgtttattcaagccaatcccgcgaggtttaccggatttgcatatcatcctttggaacaaaaggatgcgtatgaggagctgaaaagagcggttgaagagctcggtctgaaaggatataaactgttcgggccgctgacagacatcgagtttcatgatccgtcgctgaaaaagctgtggacgtatctggctgacaaaagactgcctgtattaattcacttcggacttttagggagagcggggggcattgtcagccatcgcaacatcaacccgctctccatctatcgcgtcgcgagagagtatgctgatataccgttcatcattccgcatttcggcgccggatattatcaggaactgctgcagctgtgctggagctgcccgaatgtgtatattgacacgtccggctcaaatcagtggatgaggtggatgccgtaccggcttgatttggaaattctgtttcgaaagacatctgaattaatcggtgctgaacggatcatcttcgggacggattcgaacggatttccgagaggatatgtatacagatatcttcaggagcaggtgaggacctgccgggaaatcaatatgcgggaagaagatatagaaaacattttcggcaacaacgcgcagacattattgaaaatcgcccggaaagaaaaggaagtaaatacgtga

SEQ ID NO: 76 - protein, 311 aa, Bacillus amyloliquefaciens
MLFRQHFKPVDIHGHLPYSLNFGKNDKTFSDYNRERSERMNLTWDFPDPHDVDGDDGEIALMTRWEKELDKYGIDVLNFLTAESNDRMAAFIQANPARFTGFAYHPLEQKDAYEELKRAVEELGLKGYKLFGPLTDIEFHDPSLKKLWTYLADKRLPVLIHFGLLGRAGGIVSHRNINPLSIYRVAREYADIPFIIPHFGAGYYQELLQLCWSCPNVYIDTSGSNQWMRWMPYRLDLEILFRKTSELIGAERIIFGTDSNGFPRGYVYRYLQEQVRTCREINMREEDIENIFGNNAQTLLKIARKEKEVNT

SEQ ID NO: 77 - DNA, 633 bp, Bacillus amyloliquefaciens
gtgaaacatcataaaacgtaccattcttcatcaattcagacagcagccggccctctattggtagaagggcccgttcctccaaaggacctagcacagtatgagtttcatgaaggcctgacagcctttcgccttcctcatgaacagcacaaagcgttaatcgagatcgccgggcttcctgaaggtcggatcattatcgccagggacggacagacgattatcggctatgtgacgtatttatatcctgatccgcttgaacggtggtctgacggcaatatggaagatctccttgagctcggggcgatcgaggtcgctcccggctacaggggctgttctgtcggaaaaacgttgctgacagtcagcatgatggatgaacagatggaacgctacatcatcatgacgacggaatattactggcattgggatttaaaaggaatgaaaaaagatgtgtgggaatacagaaagatcatggaaaagatgatgaatgccgggggtcttgtctggtttgcaacggatgaaccggaaatcagctctcatccggccaattgtctgatggcccgcatcggcaggcacgtcagtcaggagtcaattgaacagttcgacaggcttcgtttttatcagcggtttatgtattga

SEQ ID NO: 78 - protein, 210 aa, Bacillus amyloliquefaciens
MKHHKTYHSSSIQTAAGPLLVEGPVPPKDLAQYEFHEGLTAFRLPHEQHKALIEIAGLPEGRIIIARDGQTIIGYVTYLYPDPLERWSDGNMEDLLELGAIEVAPGYRGCSVGKTLLTVSMMDEQMERYIIMTTEYYWHWDLKGMKKDVWEYRKIMEKMMNAGGLVWFATDEPEISSHPANCLMARIGRHVSQESIEQFDRLRFYQRFMY

SEQ ID NO: 79 - DNA, 750 bp, Bacillus amyloliquefaciens
atgaaacatgaacatgcagccgttgtactagatttcagtgcaaacgggattgggatcattcgcagcctggcccgaagaggaatcgatgtttacgcatttgacacggagggaccttatcgtatcggaaaatcaagattggcagattgcgggatatgtcccagccctttaacacaagaggaagaactgctgacattcctgactgatttcgggaagcgattccaagcaaagccggttctgtatgcaggttctgatgattatgcgggatttatatctaaattccgcgagacattagccggtttttttttatttttgctcccgagccgctctctgttagaaacggtcttagataaaagcaaagcatatgaattagcggtcaagcataacatcccctgcccgaaaaccttttttccgaacaaccgggatgagctggaagaggccatcgccaatattgacttcccgtgtattttaaaaccggtggccggccatgaatacagaaaaaaagtaaacaaaaaagcaattgtaatgaaggatgccgcacaattgcgcaaggagttcagctcctacagagaaaatggagaactgctcgtgcaggagatcatccccggagacaaccagtgtttttataaagtcgccactttttatgatgaccaaatgaaattaatgggcttattctctctgcaaaagaaccatcaattccctgctgattttggcgcggggcccacgtcgtcagcaaacggcttcctgatttaa

SEQ ID NO: 80 - protein, 249 aa, Bacillus amyloliquefaciens
MKHEHAAVVLDFSANGIGIIRSLARRGIDVYAFDTEGPYRIGKSRLADCGICPSPLTQEEELLTFLTDFGKRFQAKPVLYAGSDDYAGFISKFRETLAGFFLFLLPSRSLLETVLDKSKAYELAVKHNIPCPKTFFPNNRDELEEAIANIDFPCILKPVAGHEYRKKVNKKAIVMKDAAQLRKEFSSYRENGELLVQEIIPGDNQCFYKVATFYDDQMKLMGLFSLQKNHQFPADFGAGPTSSANGFLI

SEQ ID NO: 81 - DNA, 1002 bp, Bacillus amyloliquefaciens
atgatgaacgacgctttaacgagtttggcatgtagtctggcaccggggacggcaattcagggcaaatggaacggcaaatcctacagattgctcaaacagcttggaaaaggggctaacggtattgtatatctggcagaagcatcaggcggacaggtcgctttgaaaataagcagcgacagcatgtctgttacctctgaagtgaatgtcttaaaatccttttcaaaggcccggtcgcaaacgatggggccttctttttttgatgcggacgatgcgtttattccgcagctgaataaaaatgtctctttttacgtgatggagtacatagaagggccgcttcttccgcaatatatcagcagtaagggagcggagtggattccggtgctgatggtgcagcttctttccagcttgtcagtccttcatcagcagggatgggtttttggcgacctcaaaccggaaaatcttattgtaaccggaccgccggctgccatccgctgcattgatgtagggggaacgacaaaacaaggccgcgcgattaaagagtatacggagttttacgacaggggctattgggggtatggaacaagaaaagcagaaccatcctatgacctgtttgctgtcgcaatgatcatgatccactgtgtccagaagaaagagtgcaaaaagtcaggacagccgaaagaacagcttcgttctatcattgaaggccacccgtttctgaataagtataagaaggttctgttttctgctttaaacggccaatatccgtctgcggaagccatgaagcatgacatcctgacggcggggcagagcgccgggagtaaaaggaaagccgccgccaagcctaagccgccgcaatcaaaaccgcggcagggcactgtatctcaaacgcggtataaacctaaacaaaaacccgcaaagcacaatggtttgtttgaaacaacgcttattttaatcagcgttctcgccctttatttcgcttacatcgtcttttttctcatctaa

SEQ ID NO: 82 - protein, 333 aa, Bacillus amyloliquefaciens
MMNDALTSLACSLAPGTAIQGKWNGKSYRLLKQLGKGANGIVYLAEASGGQVALKISSDSMSVTSEVNVLKSFSKARSQTMGPSFFDADDAFIPQLNKNVSFYVMEYIEGPLLPQYISSKGAEWIPVLMVQLLSSLSVLHQQGWVFGDLKPENLIVTGPPAAIRCIDVGGTTKQGRAIKEYTEFYDRGYWGYGTRKAEPSYDLFAVAMIMIHCVQKKECKKSGQPKEQLRSIIEGHPFLNKYKKVLFSALNGQYPSAEAMKHDILTAGQSAGSKRKAAAKPKPPQSKPRQGTVSQTRYKPKQKPAKHNGLFETTLILISVLALYFAYIVFFLI

SEQ ID NO: 83 - DNA, 813 bp, Bacillus amyloliquefaciens
atggcaaatgaaacgtatgaatcattaaacaaacgtttaatcaatatccgccgcgaccttcatgaacaccctgagctgtcaggcgaggaattcgaaacgacgaataaaatccgccgctggctggaggaagaaggaatcacggttcttgatgtgccgaaacttcaaaccggagtgatcgctgaaatcaaaggagataaaagcggccccgtcatcgccgtcagagcggacatcgacgcactgccgatcgaagagaaaacaaaccttccgtttgcttcgcgcaacagcggcgtgatgcacgcatgcggccatgatttccatacggcatctatcctcggcacggctttcttattaaatgagagaaagcatgagctgaaaggaacggtgcggtttatttttcagcccgcggaagaaatcgccgccggagcaagacaggtcattgaagccggcgcgcttgacggtgtatcggcgatattcggcatgcataacaaacctgacctccccgtcggcacggtcggtctgaaagaaggcccgcttatggcgagtgtcgaccgctttgaaatcaccgtgaaaggaaaaggcggccacgccggaatccccgacaacagcattgacccgattcaggcgacagggcagatcatcggcggcctgcaatcgattgtcagcagaaacatcagctcgcttcacaatgccgtcgtcagcatcacaagagttcagggggcagttcttggaatgtcattccggaccatgttgaaatggaaggaaccgtccggacgtttcaaaaagaagcgcgggacgctgttccgaaacatatga

SEQ ID NO: 84 - protein, 270 aa, Bacillus amyloliquefaciens
MANETYESLNKRLINIRRDLHEHPELSGEEFETTNKIRRWLEEEGITVLDVPKLQTGVIAEIKGDKSGPVIAVRADIDALPIEEKTNLPFASRNSGVMHACGHDFHTASILGTAFLLNERKHELKGTVRFIFQPAEEIAAGARQVIEAGALDGVSAIFGMHNKPDLPVGTVGLKEGPLMASVDRFEITVKGKGGHAGIPDNSIDPIQATGQIIGGLQSIVSRNISSLHNAVVSITRVQGAVLGMSFRTMLKWKEPSGRFKKKRGTLFRNI

SEQ ID NO: 85 - DNA, 318 bp, Bacillus amyloliquefaciens
gtgacatggattgcagttgtttcaattgttgtcataagcctgattaagattgtgctgacatgccttcctaccggagcggtggaatggatcctccgcaagtttgaaacccattcaaagctcagtgacgagtccgctgccgtttccctcgggggaaaacgtctggaaggcgaagacaaacgacgggtgattgatgattttaacgaagccgtgtttatcgaacggcattatatatacccagggatgaagagcgttatcttcatccgcaaaacggagccgatccgcttgtcattaagacgagaaaaggaaaaaaagatgtga

SEQ ID NO: 86 - protein, 105 aa, Bacillus amyloliquefaciens
MTWIAVVSIVVISLIKIVLTCLPTGAVEWILRKFETHSKLSDESAAVSLGGKRLEGEDKRRVIDDFNEAVFIERHYIYPGMKSVIFIRKTEPIRLSLRREKEKKM

SEQ ID NO: 87 - DNA, 768 bp, Bacillus amyloliquefaciens
atgcagtatattcgttatgaagaaaagggaaagatcgcagagattgtgctgaaccgtcctgacagttacaacgcgctgaatgaacaaatgctccgggaattggaaaatgcatgcgttatggcagccgacagcgaagcgcttatcgtcctcttgcggggggaaggccggggattttccgcgggcggtgatatccagatgatgacgtcggatcatgattcgggagaatatgaacggctcatgaaaatgattgaatccattacgctgacgctctatgatatgaaaaaaattgtgatagccgccatccacggagccgcggcggggctcgggctgagtttcgcgctgtgcgccgatgtggtgctcgccgaagaaaacgcccgactcgcgatgaatttcatcggcatcggattggttcccgacggaggaggccattatttattaatgagacgcgtcggtgagatcgaagcgaaaaaactgatttggagcggtgaaaaattgccggctgaaaaagcggtgcggctcaagcttgccgacgggctgttcagcggcggccctgcggagggggcacaaccgtatatcgaccgattgctgcatgcgccgctgtcagcgatgattgaaacgaaggctatttatcagagcctccatatcagccggttaaaagacgttttatctcttgaacgaaaggcccaggaaaatatgagaaaaacggatgatcataaagagggcatccgcgcctttttagaaaaacggacgccgcaatttaaccggtaa

SEQ ID NO: 88 - protein, 255 aa, Bacillus amyloliquefaciens
MQYIRYEEKGKIAEIVLNRPDSYNALNEQMLRELENACVMAADSEALIVLLRGEGRGFSAGGDIQMMTSDHDSGEYERLMKMIESITLTLYDMKKIVIAAIHGAAAGLGLSFALCADVVLAEENARLAMNFIGIGLVPDGGGHYLLMRRVGEIEAKKLIWSGEKLPAEKAVRLKLADGLFSGGPAEGAQPYIDRLLHAPLSAMIETKAIYQSLHISRLKDVLSLERKAQENMRKTDDHKEGIRAFLEKRTPQFNR

SEQ ID NO: 89 - DNA, 402 bp, Bacillus amyloliquefaciens
atggcgggagaaggaaagcctttgccgattgaattttaccagagaccgtcagtggagcttgcccctttattgctcggctgtctccttgtgaaggagacggatgagggaacggcttcaggttatatcgtggaaacggaagcttatatgggagcggatgaccgggcggcgcacagtttcggcaaccggcgcacgaaacggacggaaattatgttccatgaggcgggccgcatttatacatacgtcatgcacactcatacattaatgaacgtcgtcgcctcggacatcggcattccgcaggccgtgttaatcagggcggcggagcctcatgaaggacagttcctgatggagagcaggagaccgggcagaccccgagagagtggacaaacggcccgggaaaactga

SEQ ID NO: 90 - protein, 133 aa, Bacillus amyloliquefaciens
MAGEGKPLPIEFYQRPSVELAPLLLGCLLVKETDEGTASGYIVETEAYMGADDRAAHSFGNRRTKRTEIMFHEAGRIYTYVMHTHTLMNVVASDIGIPQAVLIRAAEPHEGQFLMESRRPGRPRESGQTAREN

SEQ ID NO: 91 - DNA, 348 bp, Bacillus amyloliquefaciens
atgaatgaagaatacacatatgcagcagatagtgatatgagaccgtttggacggcccggatttgggtttggacggccgggcttcgggttcgggcggcccggattcggcttcggcttcgggcggccgggttttggatttggccggccttggtttggttatggattcggacggccgtttggtttttacggcggaccgttcttcggagggcttgtcgggggcttgtcggaagcgctttattcaatccgtacctgtacggaggttacggctacccttactatccgtattactactaagacaatcaaaaagggctcctttcaggggcctttttatataggcctaatgtcttga

SEQ ID NO: 92 - protein, 115 aa, Bacillus amyloliquefaciens
MNEEYTYAADSDMRPFGRPGFGFGRPGFGFGRPGFGFGFGRPGFGFGRPWFGYGFGRPFGFYGGPFFGGLVGGLSEALYSIRTCTEVTATLTIRITTKTIKKGSFQGPFYIGLMS

SEQ ID NO: 93 - DNA, 591 bp, Bacillus amyloliquefaciens
atgaacgataacttcaagaaaaccaatcgtatttcaatgcttcagcaattgcagattaatggcagtgaacaaaccattatgattaatggtgatgacaggagtagtccgctgcttttgtttttgcatggcggtcccggcacgcctcaaatcggttatgcgagaaaataccagaatgagctggaaaagcatttcaccgttgtgaactgggatcagagaggggcgggtctctcttattcaaaggaaattccgggttcatctatgactttggatcagctgacagctgacaccattcatctgaccgaacgcttatgcaagcaattcagcaggagaaaaatatatatcgccggctattcgtggggttcagttttggcgcttcaagttcttcaagagaaacctgatttgtattatgcgtatatcggtatcagtcaggtggttaatattcaaaaggaagaaacggaagcctaccggttgatgatggaatggagcaggcaacacaaacatatcctgctgggcaagacgctgagctttatcggagcaccccatgggagaaacagctgcagcgaacgctgtttctgctttgtattgaaatga

SEQ ID NO: 94 - protein, 196 aa, Bacillus amyloliquefaciens
MNDNFKKTNRISMLQQLQINGSEQTIMINGDDRSSPLLLFLHGGPGTPQIGYARKYQNELEKHFTVVNWDQRGAGLSYSKEIPGSSMTLDQLTADTIHLTERLCKQFSRRKIYIAGYSWGSVLALQVLQEKPDLYYAYIGISQVVNIQKEETEAYRLMMEWSRQHKHILLGKTLSFIGAPHGRNSCSERCFCFVLK

SEQ ID NO: 95 - DNA, 1191 bp, Bacillus amyloliquefaciens
gtggctgaaagcttgttaatcagcggtgcggacatcgtaacagaaaaagaaatcatccgaaacggttttctcggtataaaggacggcatcatttcttacgcgggaaaaacaaggccgcaagaaacgtatgagaaggaatggaaggcgcccgagggctcgtatgcgcttcccggaatgattgatatccatattcacggcggatacggcgcggatacgatggatgccgatgttgcggctcttgatacactgtccgcccggctgcccgaagaaggaacaaccgcttttttagcgacaacgatcacacagcagcacgaaaacattgaaaaagcgctcatcaacgccaaaaaatgggcgtattcctcaccggagacccaaaaaggcgctgagttgatcggcattcatttagaaggaccgtttgtctctccgaaaaaggcgggagcacagccgaaacaatggattactcctgctgatgccgggctctttcagaaatgggagcggctctcgggagggctgatcaaaatcgtgacgcttgcgccggaagaagatcctgatttcagcctgatccgttatttaaaaaaccaaaacatcatcccctcaatgggacacacagacgcaggagccgagcttttacaaaaagcggcggatgccggggcggtgcatatgacgcacctctttaacgccatgagctcctttcatcaccgtgagccggggggcatcggtacggctctcgcctgcggccgcatcacggcggagctgatcactgacggcattcattctcatcctctggctgttaagcttgcctatttggcgaaaggaagccaaaacctgatcatgattacagactccatgcgggcaaaagggcttaaggacggagaatacgaattcggcggacaaaaagtcaccgttcgcggggacacggcgcttctctctgacgggacgctggccggttccattttaaaaatgaatgaaggcgcggcgctcatgcgcaggtttacaaactgctcatggccggatatagcaaatatgacatcggcaaatgcggcccgccgcctcggcatattcgaccgtaaaggaagcatcgccgaaggaaaagacgccgacgttgttctgacggacggacagtgcggcgtgctggccacgatttgccgcggaaacaccgcatatatctcaagggaggctgattggacatga

SEQ ID NO: 96 - protein, 396 aa, Bacillus amyloliquefaciens
MAESLLISGADIVTEKEIIRNGFLGIKDGIISYAGKTRPQETYEKEWKAPEGSYALPGMIDIHIHGGYGADTMDADVAALDTLSARLPEEGTTAFLATTITQQHENIEKALINAKKWAYSSPETQKGAELIGIHLEGPFVSPKKAGAQPKQWITPADAGLFQKWERLSGGLIKIVTLAPEEDPDFSLIRYLKNQNIIPSMGHTDAGAELLQKAADAGAVHMTHLFNAMSSFHHREPGGIGTALACGRITAELITDGIHSHPLAVKLAYLAKGSQNLIMITDSMRAKGLKDGEYEFGGQKVTVRGDTALLSDGTLAGSILKMNEGAALMRRFTNCSWPDIANMTSANAARRLGIFDRKGSIAEGKDADVVLTDGQCGVLATICRGNTAYISREADWT

SEQ ID NO: 97 - DNA, 246 bp, Bacillus amyloliquefaciens
ttgctgcgcgccttaaaactgtcactcgcgatgctgattattatacttgcggccgccgcatttacgtatgcggaacatacctccgtcatacagccggttatgctcgtgtttctcggtgcggtcatgttcattcaggggctggaggaaaaacggaaagaaaacgacggctccgggaaattcaatatctataccgccgtttttgtatggtcgatctccttaatcggttttacgcttcacgcgatctga

SEQ ID NO: 98 - protein, 81 aa, Bacillus amyloliquefaciens
MLRALKLSLAMLIIILAAAAFTYAEHTSVIQPVMLVFLGAVMFIQGLEEKRKENDGSGKFNIYTAVFVWSISLIGFTLHAI

SEQ ID NO: 99 - DNA, 837 bp, Bacillus amyloliquefaciens
ttgtctaaaacatatcaaaagtggatcgtattgggattattttttatcgtactgtgcacaggccgctcggcttttgcggcgacatctcagactcagacgggaggcctcgggaatatcggttttttccacgattacctgatcgagccgttttcggcacttttaaaaggggtggcgggcctgttccacggtgagtacggactgtcgattattctggtgacgattatcgtccggatcgttgtattgcctttgtttgtgaaccaatttaagaaacagcgggtgttccaggaaaaaatggctgtgatcaaaccgcaggtcgacagcattcaggctaaaatgaaacaaacgaaagatgcggaaaaacaaaaagaactgcaaatggaaatgatgaagctttaccgtgagcacaatctgaatccgatggcaatgggatgtcttccgatgctggtgcaattcccgattttgatcggtttttattacgccatccgctcaacgccggaaattgcttcacactcatttctgtggttcagcttagggcattctgatattcttgtatcactgtgcgcgggggccatgtatttcttacaggcttatatttcccaaaaattaaacgagaaatattcaccggctgctcaaaatccggccgcgatgcagtcagcaaaaatcatggtctttattttccctgtcatgatgaccgttttttcgcttaacgtaccggctgcgctgccgctttactggtttacaagcggactgtttttgacagtgcagaacgtacttttacagcagacgcatcataaaaagaaacaggctgcggctcaggcggagcccgccaaatcataa

SEQ ID NO: 100 - protein, 278 aa, Bacillus amyloliquefaciens
MSKTYQKWIVLGLFFIVLCTGRSAFAATSQTQTGGLGNIGFFHDYLIEPFSALLKGVAGLFHGEYGLSIILVTIIVRIVVLPLFVNQFKKQRVFQEKMAVIKPQVDSIQAKMKQTKDAEKQKELQMEMMKLYREHNLNPMAMGCLPMLVQFPILIGFYYAIRSTPEIASHSFLWFSLGHSDILVSLCAGAMYFLQAYISQKLNEKYSPAAQNPAAMQSAKIMVFIFPVMMTVFSLNVPAALPLYWFTSGLFLTVQNVLLQQTHHKKKQAAAQAEPAKS

SEQ ID NO: 101 - DNA, 2784 bp, Bacillus amyloliquefaciens
atgtcagatcaatttacgagccgtgaagaacgccgtaaggcaaggcagacgaaaagcactaagccctcttcaccgaaaaaaggcaagaaacagcgtaaaggcggtttattcaaaaagattgtgctgtccttggttattctgtttgtccttggcatagtcggcggagcggcggcatttgccgttttggtttccggcgcgccgtctttggacgaagccaagctgaaaacgccttactcttcaacgatttacgataaaaacggaaaagaaatcgcggaagtgggcggtgaaaaacgaacctacgtcccgattaaggatatacccgatgttgtgaaagaagcatttatcgcaactgaagacgcccgtttttataagcaccacggtatagacccgattcgtatcggaggcgctttggtcgccaactttacggatgggttcggttcagagggaggaagcacaatcacccagcaggttgtgaaaaactcgcttttgacccatcagaaaacgattaaacggaaagcacaggaagtgtggctttccctgcagctggagcgccattattctaaagatgaaatcttagaaatgtatttaaacagaatttatttctcaccgcgcgcctacggcgtcggaaaagcggctgaagaattcttcggcgtaaaagacttgagcaagcttacggttgaacaggcggcaacgcttgccggaatgccgcaaagcccgaccggatataacccggttaaaaacccgaaggcttccgaaaaacgacgaaacatcgttctcagcttaatggaaaaacaaggattcatttcaaactctgaataccaaaaagcgaagaaagtgtccatgaaagatgaaggcgtcgtcagccaaaaggaatacgataaaaaggacacaaataaatacagcgcttttgtcgaagaagttatgaaagaaattgagacaaaagaaaagaaagacgtcgatatttcaactgacggactgaaaatttacacgactcttgatacgaaagcacaagattatcttgatcaattgatgaacggcgatacagccggatttaccgaaggcatgcagggcggcgtcacgctccttgatacgacaaacggagaaatccgcgccatcggggcaggacggaacagaactaccgggggattcaattatgcaacacaaggtaaaacccagcccggttcgacgataaaaccgattcttgattacggaccggtcattgaaaataaaaaatggtcgacgtatgaacagattgacgactcagcttatacgtactctgacggcacaccgattcatgattgggacaataaatacagaggccagatatcaatgcgagaggccctcgcagactcacgtaatattcctgctttaaaagcataccaagcagcaggaaaagatcatgccgtcgacttcgcaaacgacttaggattgggattaaacaaagatcaagtatatgaaccctactctatcgggggatttggtgagggtaaccgcggtgtatctactatgaccatggcaggcgcctacagtgcgttcggaaataacggaacgtacaacgaaccgcacgcggtcacatcgattgaatttaatgacggcactaagcttgatttaacaccgaaaccgaaaagtgctatgagcgactacacagcgtttatgattacagatatgctcaaatcagctgtcgaatcaggaacaggtaaactggctcaggtggcgaacgtggaagtcgccggtaaaacgggtacgaccaactttactaaagaggacattcaaaaatataacattgctccaggcggagtcccagactcatggtttgtcggatacacccctcaatatacagcggcggtttggaccggagttgagtctggcaacaaagcaggcaagaaatcactgtcttctgcagaccagcaagtcgcaaaacggattttccaaaagctgatctcatacgttgatgacggtaaaggaagcttcaagcagcctgacagcgttgtaaaagaaacagttgagaaaggctcgaatcctgccgctttagccggaccgaatacgccggatgataaaaaagtgacggagtacttcgtgaaaggaacgcagccaactgccgtttctaaaacgtacacgaaagaaaaagccgataaaccgacaggattgcaagtgaaatacgacaaagataaaaaatcattaaccttaagctgggattatgacggtgatgcaacattcaatgtcaaacaatccgttgacggcggaagctacagtgacattcaaaacagttcggcaaaagaagccgtcgtctcaaatgtcacgccaggctccacatacagcttccaggtgacagcggaaaacgatgacggaaaaagcgatacggcatcagcatctttcaaagtcccgaaagatgaagaagacgatgcggataaagataaagcgactgacgatgaacagaagactgatgaagataaagataaggacaagacgcaaaccgatgattcaaacaaagatgacgatcagacagatacgtctgacggatcggatcaaacaccaactgatgacccggataaaaatcaggatcaatccgataaggatcaaacagataacaacaatcagaatcagcccggcaacgggaccgataacaacggacagcaagataacggctctgataatgattccgattccggttcagacggctcaaataaacctgacagcggtcaaacggataaaaaccaagactcatcttcaactatcaacgggcagtccaattcgtcaaccatccagtcaaatcccgctcattag

SEQ ID NO: 102 - protein, 927 aa, Bacillus amyloliquefaciens
MSDQFTSREERRKARQTKSTKPSSPKKGKKQRKGGLFKKIVLSLVILFVLGIVGGAAAFAVLVSGAPSLDEAKLKTPYSSTIYDKNGKEIAEVGGEKRTYVPIKDIPDVVKEAFIATEDARFYKHHGIDPIRIGGALVANFTDGFGSEGGSTITQQVVKNSLLTHQKTIKRKAQEVWLSLQLERHYSKDEILEMYLNRIYFSPRAYGVGKAAEEFFGVKDLSKLTVEQAATLAGMPQSPTGYNPVKNPKASEKRRNIVLSLMEKQGFISNSEYQKAKKVSMKDEGVVSQKEYDKKDTNKYSAFVEEVMKEIETKEKKDVDISTDGLKIYTTLDTKAQDYLDQLMNGDTAGFTEGMQGGVTLLDTTNGEIRAIGAGRNRTTGGFNYATQGKTQPGSTIKPILDYGPVIENKKWSTYEQIDDSAYTYSDGTPIHDWDNKYRGQISMREALADSRNIPALKAYQAAGKDHAVDFANDLGLGLNKDQVYEPYSIGGFGEGNRGVSTMTMAGAYSAFGNNGTYNEPHAVTSIEFNDGTKLDLTPKPKSAMSDYTAFMITDMLKSAVESGTGKLAQVANVEVAGKTGTTNFTKEDIQKYNIAPGGVPDSWFVGYTPQYTAAVWTGVESGNKAGKKSLSSADQQVAKRIFQKLISYVDDGKGSFKQPDSVVKETVEKGSNPAALAGPNTPDDKKVTEYFVKGTQPTAVSKTYTKEKADKPTGLQVKYDKDKKSLTLSWDYDGDATFNVKQSVDGGSYSDIQNSSAKEAVVSNVTPGSTYSFQVTAENDDGKSDTASASFKVPKDEEDDADKDKATDDEQKTDEDKDKDKTQTDDSNKDDDQTDTSDGSDQTPTDDPDKNQDQSDKDQTDNNNQNQPGNGTDNNGQQDNGSDNDSDSGSDGSNKPDSGQTDKNQDSSSTINGQSNSSTIQSNPAH

SEQ ID NO: 103 - DNA, 948 bp, Bacillus amyloliquefaciens
atgagtggcgataaaaaacatctggtcatcatcggcggcggcataacgggactagccgccgccttctacatggaaaaagaaatcaaggaaaaacagctgccgcttgaggtcaccctgatcgaagcgggcccgagagcgggcggcaaaattcagacggcgcataaagacggctacatcattgagcgggggccggattcttttttagaaaggaaaaaaagcgcgccgcagctcgttaaggatttggggcttgagcatctgctcgtcaacaatgcgaccggccagtcttacgtgctcgtcaatgagacgcttcatccgatgccgaagggcgcggtgatgggcattccgaccaaaatcgctccgttcatctccaccggtttattttctgtacccggaaaagcgcgggcggcgcttgactttgtcctgcctgcgagcaaaccgaaggaagatcagtctctgggtgaatttttccgcagacgcgtcggtgacgaagtcgttgagaatttaatagaaccgctattatcagggatttatgccggagatattgataagctgagcctcatgtccacgtttccgcaattctatcagactgagcaaaagcacagaagcctgattctcggtatgaaaaaatcacgtccgcagccttcgggacagcagctgacggccaaaaagcagggccagtttttaacggtgacgacaggacttcaaacgttggtggaggagctggaaaagcagcttacgctgacaaaggtgatgaaaggaacgaaagtcacccatatcggccgcgaggagaaaggatattccgtgacgcttgataatggcaaagtgctctatgcggaaggatgcatagtgacagcccgcataaagccgcggcgaaaatgctttctgatctgccggcggtttcatgtctcaaagatatgcattctacgtccgttgccaacgtcgccttag

SEQ ID NO: 104 - protein, 315 aa, Bacillus amyloliquefaciens
MSGDKKHLVIIGGGITGLAAAFYMEKEIKEKQLPLEVTLIEAGPRAGGKIQTAHKDGYIIERGPDSFLERKKSAPQLVKDLGLEHLLVNNATGQSYVLVNETLHPMPKGAVMGIPTKIAPFISTGLFSVPGKARAALDFVLPASKPKEDQSLGEFFRRRVGDEVVENLIEPLLSGIYAGDIDKLSLMSTFPQFYQTEQKHRSLILGMKKSRPQPSGQQLTAKKQGQFLTVTTGLQTLVEELEKQLTLTKVMKGTKVTHIGREEKGYSVTLDNGKVLYAEGCIVTARIKPRRKCFLICRRFHVSKICILRPLPTSP

SEQ ID NO: 105 - DNA, 1626 bp, Bacillus amyloliquefaciens
gtgctgactggatttacgccatggccggaagaatgggctgaaaaataccgaaaagacggctgctggaagggtgagacgttcggaggaatgctgaaagagcgcgcggctttatacggaaatcaaactgccgtgacgtgtaaagatgtacattggacctacaaagaattagatgaaagggccgatcgtttagcggcggggctgcataagctcggaattcaaaaggaagaccgcgttgtcgttcagctgccgaatatcgctgagttttttgaagtgattttcgcgctgttccgactcggagcactgcccgttttcgcgctgccttctcatagaagcagtgagattacgtatttctgcgagtttgcagaggcgaaagcatacatcattcctgatacgcattcaggttttgattacagggcgcttgccagacaggtgaaagacaaacttccggatttggcgcatgtcattgtggccggcgaagctgaagagtttcaggaactgagcagcctgcatagagagcctgttcagctggaagaggtaagcccggcggaagtcgcttttttacagctttcaggaggcagtacggggctgtccaagctgattccgcgaacacacgacgattacatatacagtttgcgcctcagcgcggaaatatgcggcttggatcatcacagcgtttatttggccgctctgccgacagcgcataattatccgctcagctcgccgggtgtgctgggaactttatatgccggaggccgtgttgttctgtcaccgacgccgagtccggatgactgcttcccgttaattgaaaaagaacgtgtcacgattacagcgctcgtcccgccgcttgcgatggtgtggatggacgcatccggttcgcgaagtgatgatttatcaagccttcaagtgctgcaggtgggaggcgccaaattcagtgctgaggcggcccgccgcgtaaagagcgctttcggatgcacccttcagcaggttttcggaatggcggaaggattggtgaattatacgagactggatgatcctgaagagatcattgtcaatacgcaaggcagaccgatgtcaccttttgatgaggtaagggttttagacgatgacgggcgggatgtcgcccccggagaagcgggacatttgtttacacgcggcccttacacgattcgcgggtattataaagcgcctgaacataatgaaagatcattcacagccgacggattttatcagaccggcgatatcgtcaaactgacggcggacggctatatcatcgttgaaggacgtgcgaaagatcaaatcaatcggggcggcgaaaagattgccgctgaagaggtggaaaatcaccttctggcccatcctgccgttcatgatgcggccatggtttcaatgccggatgattttctcggagagcggtcctgtgtgttcgtcattccgaaaggagaagcgccgaaaccgggagagctgaaagcgtttttacgggagcgcgggctggcggcatataaaattcccgaccgggttgaatttatcgcttctttcccgaaaaccggcgtcggcaaggtcagcaaaaaggaccttcgcgaaacgatcgcccaaaaattgaagcctgctgaaatcaaacaatcttaa

SEQ ID NO: 106 - protein, 541 aa, Bacillus amyloliquefaciens
MLTGFTPWPEEWAEKYRKDGCWKGETFGGMLKERAALYGNQTAVTCKDVHWTYKELDERADRLAAGLHKLGIQKEDRVVVQLPNIAEFFEVIFALFRLGALPVFALPSHRSSEITYFCEFAEAKAYIIPDTHSGFDYRALARQVKDKLPDLAHVIVAGEAEEFQELSSLHREPVQLEEVSPAEVAFLQLSGGSTGLSKLIPRTHDDYIYSLRLSAEICGLDHHSVYLAALPTAHNYPLSSPGVLGTLYAGGRVVLSPTPSPDDCFPLIEKERVTITALVPPLAMVWMDASGSRSDDLSSLQVLQVGGAKFSAEAARRVKSAFGCTLQQVFGMAEGLVNYTRLDDPEEIIVNTQGRPMSPFDEVRVLDDDGRDVAPGEAGHLFTRGPYTIRGYYKAPEHNERSFTADGFYQTGDIVKLTADGYIIVEGRAKDQINRGGEKIAAEEVENHLLAHPAVHDAAMVSMPDDFLGERSCVFVIPKGEAPKPGELKAFLRERGLAAYKIPDRVEFIASFPKTGVGKVSKKDLRETIAQKLKPAEIKQS

SEQ ID NO: 107 - DNA, 1173 bp, Bacillus amyloliquefaciens
atgaaagaaatgttaaaaataagcggcatcagttacgaaatcaacagcgttcccctttttgaacagatcagcgcgagtgttcagcaaggcgacatcatcggtgttatcggtaaaaacggcgccggcaaatctttattgctgcaattgatctgcaataaaaaagcgccgtcacaaggacagatccagatgatgcaagatgtgaacatatatatggtggaacaagaaacggaagcttatgattccggccatccggagcctgcggaggcagccttgttagaaaagtggaacgtgcccgcacgcgccttttcgcaattaagcggcggagaaaaattgaaagcccgtcttgccaaaggtttctcctcctcaagcggccttttgttattagatgagccgacgaaccacctcgatcagcacagtttagaaatactgcttaatcagatcaagaattacaaaggcaccattattttcgtttcacatgatcgtgcttttatagatgcggcggcgacaaaaatctgggccatcgaaggaaagaaactcattgaacataaagggaattattcaagctatatggaggtccgcaaacagagaaggctgacacagcagcgggaatatgagaatcagcagcatatgatcagacggattgaagctcaaatgaacgagctgagcgcctggtcaaaaaaagcccacgcccaatcaacgaaaatagaaggctttaaagaatatcaccgcgtaaaagcaaaacgcacggacgcccagattaaatcaaagcagaagcgtcttgaaaaagagcttgaaaaagcgaaagcagaaccggttgaagcggagtatgaagtccgtttttccattgagcaccgcaaaaaagcgggaaagcgttttttagaagtaagtgatgtcacaaagtcatatgaaggccgaacgctttttaaaaacgtgaatttcactgtgatgcacggtgaaaagatcgcgattacaggcccgaacggcagcgggaaaacaacattattgaaggtcatcctcggtcaggaaaaagcgcagggcggcatatggatttctccgtctgcaaacgtcggctatttaacccaggaagtattcgaccttccgcttgataaaaccccgaacagcttttttacaaagaaacgttcgaagcaaggggaaatgttcaatccctcatga

SEQ ID NO: 108 - protein, 390 aa, Bacillus amyloliquefaciens
MKEMLKISGISYEINSVPLFEQISASVQQGDIIGVIGKNGAGKSLLLQLICNKKAPSQGQIQMMQDVNIYMVEQETEAYDSGHPEPAEAALLEKWNVPARAFSQLSGGEKLKARLAKGFSSSSGLLLLDEPTNHLDQHSLEILLNQIKNYKGTIIFVSHDRAFIDAAATKIWAIEGKKLIEHKGNYSSYMEVRKQRRLTQQREYENQQHMIRRIEAQMNELSAWSKKAHAQSTKIEGFKEYHRVKAKRTDAQIKSKQKRLEKELEKAKAEPVEAEYEVRFSIEHRKKAGKRFLEVSDVTKSYEGRTLFKNVNFTVMHGEKIAITGPNGSGKTTLLKVILGQEKAQGGIWISPSANVGYLTQEVFDLPLDKTPNSFFTKKRSKQGEMFNPS

SEQ ID NO: 109 - DNA, 1533 bp, Bacillus amyloliquefaciens
atgaatcgggtcttccgtaataccattttttatttacttattttattagtagtaatcggggttgtgagttacttccagacctcaaacccgaaaacagaaaatatgtcgtacagtacgtttatcaagaacctcgatgaagggaaagttgatagcgtatcggttcagcctgtcagaggtgtttatgaggtaaaaggacagctgaaaaaatacgacaaagaccagtactttttaacacatgttcctgaaggaaaaggagcagaccagatatttgacgcaattaaaaagacggacgtaaaagttgatcccgcacaggaaacaagcgggtgggtgacgttcttaacgacgatcattccgtttgtcatcatctttattctgtttttcttcctgctcaatcaggctcagggcggcggcagccgtgtcatgaacttcggaaagagcaaagcgaagctgtatacggaagaaaagaaacgcgtgaagtttaaagatgtagccggcgcggatgaggagaagcaggagctcgttgaggttgttgagtttctgaaagatccccgcaaattcgccgagcttggcgccaggatccctaaaggcgtgctgcttgtcggacctccgggaaccggtaagacattgcttgcgagagcctcagccggtgaagctggcgttcctttcttcagcatcagcggatctgacttcgttgaaatgtttgtcggtgtcggtgcttcccgtgtgcgtgatttattcgaaaatgcgaaaaagaatgcgccttgcctgatcttcattgatgagatcgacgcggtaggacgtcagcgcggcgccggtcttggcggcgggcatgatgaacgcgaacagacgctgaaccagctgcttgttgagatggacggtttcagtgcgaatgaaggaatcattattatcgctgcgacaaaccgtgcggacattcttgaccctgcattgctccgtccgggacgttttgaccgtcagattacggtagaccgtccggatgtcatcggccgtgaagccgtattgcaggtgcatgcgagaaacaaaccgcttgatgagacggtgaacttaaaagcaatcgcttcaagaacacccggtttctcaggcgcagatttagaaaaccttcttaacgaagcggcactcgttgctgcccgtcaaaacaagaagaaaattgatatgcgcgacattgatgaagcaacggaccgtgtcattgcgggtcctgcgaagaagagccgcgtcatctcgaaaaaagaacgcaatatcgtggcgtaccacgagggcggtcacaccgttatcggacttgtgctggatgaagccgatatggttcataaagtaacgattgttccgaggggcaggcaggcggatacgcagtcatgcttccgagagaagaccgttacttccagacaaaacctgaacttctcgataaaattgtcggtcttctgggcggacgtgttgccgaggaaattatcttcggcgaagtcagcacgggggctcacaatgacttccagcgggcaacgaacattgccagaagaatggtga

SEQ ID NO: 110 - protein, 510 aa, Bacillus amyloliquefaciens
MNRVFRNTIFYLLILLVVIGVVSYFQTSNPKTENMSYSTFIKNLDEGKVDSVSVQPVRGVYEVKGQLKKYDKDQYFLTHVPEGKGADQIFDAIKKTDVKVDPAQETSGWVTFLTTIIPFVIIFILFFFLLNQAQGGGSRVMNFGKSKAKLYTEEKKRVKFKDVAGADEEKQELVEVVEFLKDPRKFAELGARIPKGVLLVGPPGTGKTLLARASAGEAGVPFFSISGSDFVEMFVGVGASRVRDLFENAKKNAPCLIFIDEIDAVGRQRGAGLGGGHDEREQTLNQLLVEMDGFSANEGIIIIAATNRADILDPALLRPGRFDRQITVDRPDVIGREAVLQVHARNKPLDETVNLKAIASRTPGFSGADLENLLNEAALVAARQNKKKIDMRDIDEATDRVIAGPAKKSRVISKKERNIVAYHEGGHTVIGLVLDEADMVHKVTIVPRGRQADTQSCFREKTVTSRQNLNFSIKLSVFWADVLPRKLSSAKSARGLTMTSSGQRTLPEEW

SEQ ID NO: 111 - DNA, 1134 bp, Bacillus amyloliquefaciens
atgggcatagcaggaacgtttctatttatgatcgtgatcggagccgcgatcggcgcggtgacgaatcatcttgccattcagatgttatttcgtccgtaccggccgtattacctgttcggaaaacgggttccgtttacgccggggctgatcccgaaaagacgggatgaattggcaaaacaaatggggctcatggtgacgaaccaccttttaaccccggaaggaataaaaaagcggcttttatcagataacgttaaaaaccaggcgcttcttttcgccgaacaattcacgcaaaaaatggccgcttccgaaatgacggtgcacgaagctttggccgccgcgggcatccggaatccgcaggaaaagacggatgcctggattgaccgttttaccgatgaaaagctttcggacctgtaccggaaatatgagcaccgcgccatcaaagactggcttcctgatgagctgcaggaaaagctggatgaaaaaatcccgctggccgcagattatatcctgaagcgtagcattgattattttgagagcgaagaagggaaagacagactcggaaatatgattgacgactttttgaattcccgggggatgctcggcggcatggtgcagatgttcctcggcaattcaagcttggcagaccgtgtgctgcctgagctgttaaagtttttgcgcaatgaggaaacgaaaaagcttctggctgatctgctttctcaagaatggggcaagctcaaatcttatacactttatgaggccgatgaaaagtggaatgcgaaagatctgctgttcagcatgaaaaagcgggctttggccgcacttcaaaccgcgccctttttcgaatgccggctcggtgacatcatctcccgttatgaaggggagattacggggacgtacgcgccgaagctgcttgatgcggcactcggcagtattgccgctcatttggaggatgtgctgaaacggctgcgtcttgaggaagtggtcaaagagcaggttgatcagtttcccgttgaacggctggaagaaatggtgctgtcgatttccaagagagaatttaagatgataacgtatttaggcggtctgctcggcgggataatcggagcaattcaggctttgtttgtcattcttttctaa

SEQ ID NO: 112 - protein, 377 aa, Bacillus amyloliquefaciens
MGIAGTFLFMIVIGAAIGAVTNHLAIQMLFRPYRPYYLFGKRVPFTPGLIPKRRDELAKQMGLMVTNHLLTPEGIKKRLLSDNVKNQALLFAEQFTQKMAASEMTVHEALAAAGIRNPQEKTDAWIDRFTDEKLSDLYRKYEHRAIKDWLPDELQEKLDEKIPLAADYILKRSIDYFESEEGKDRLGNMIDDFLNSRGMLGGMVQMFLGNSSLADRVLPELLKFLRNEETKKLLADLLSQEWGKLKSYTLYEADEKWNAKDLLFSMKKRALAALQTAPFFECRLGDIISRYEGEITGTYAPKLLDAALGSIAAHLEDVLKRLRLEEVVKEQVDQFPVERLEEMVLSISKREFKMITYLGGLLGGIIGAIQALFVILF

SEQ ID NO: 113 - DNA, 1977 bp, Bacillus amyloliquefaciens
ttgaaaaaactcataaccgaggaggacattgcgtcactcgtatccgtgacagacccgcaatatgcccctgacggcagaagagccgcttacgtccggacaacagtcaatcataagcgtgattcctattcctcagccattatggtatatgacacagaatccggcatctcaaacccgtggactttcggggacgataaaaatacaagtccgcggtggtcgcctgacggtcggcgcctcgcctttgtttctgacagggaggacggcatccctcagctgtacatcatcgacgctgccggcggagaggcggaacaggctgccgatattccttggggcgtatcagatccgatatgggcgcccgacggcagatccgtgcttgtgtccgtcagtctgacatcagcggagcgcgccgatgagaaagaaaaaaagaagcatgacgagtatgagccggttgagattcaatcattaacatataaacgtgacgggaagggcctgctgaacggaagccggacacagcttgtgctgattcatcttgaaacgggggagattcagcagctgacagatcatgaagctgatcattatggcgcggccttttcaccggatggcaggcagcttgcgtttaccgccaatttatgcgagccgggtgacgccggaaagccgagcgatgtctatctgatgaatctggcggacggaagcctgaagcagattacgccgcaccgcggttctttcggttcctgcgtgttttcaccggacggttcttatatcgcgatgctgggccatgagaatgaatttcgcaatgcgactttagagaaagcgtggctgtacgacgtgaaaactgagcggctgtcctgcctgaccgacatgctggatgttcatttgagcgatgcgctgattgcggattcaatcataggaggagtgacgccccggccggtatggacaaacgacgggcagggcttttacgttctcgggagcgagcagggaagcaccggtatttattatatctcgattgacggcctcgtatatccgatccgattagaagaagagtacgtgaacggttttgcttttcatcctgatcagaaaagctgtatcgctgtcattgccaaacccgcacagccttccgagctttacagcatttcacttgaaaatggggaagagaggcaattgacattttacaatgatcggtttatagaggagcgtatcatatccgtgccggaaaagctgcaatatgaaacaaaggacgggctgacggtaaacggctggtttttaaagccttccgtttttgaagaggatcaaacatatcccctcattctatacatacacggcgggcctcacatgatgtacggccatacgtattttcacgaattccaagtgctggccgcacaaggatatgctgtcgtgtatgtcaacccgagaggaagccacggctacggacaggattttgtcaatcgtgtcaggggtgattacggaggcggagattaccgtgatgtcatgcaggcggtggatgaagccgttcaggcgtatccgtttttagacagcggccgtctcggtgtgacgggcggaagctacggagggtttatgacgaattggattgtcggacagacaggccgttttaaagcagccgtcacgcagcgctccatttcaaattggttcagcttccacggtgtcagcgatatcggcttcttttttaccgactggcagctcggacatgatttgtttgaggaagcggataagctttgggatcgttctcctgtaaaatatgcatcccgcgtttcgacgccgcttttgatcctgcacggtgagcgagatgaccgctgtccgatagagcaggcggagcagctctttaccgcgttgaagaaactgaacaaaacgacgtcgttcatccgatttccgaaagctacgcatgagctgtcgagaagcggccatcccgaacagcggatgaaacgcatccgttatatttgttcatggtttgatgactatttgtaa

SEQ ID NO: 114 - protein, 658 aa, Bacillus amyloliquefaciens
MKKLITEEDIASLVSVTDPQYAPDGRRAAYVRTTVNHKRDSYSSAIMVYDTESGISNPWTFGDDKNTSPRWSPDGRRLAFVSDREDGIPQLYIIDAAGGEAEQAADIPWGVSDPIWAPDGRSVLVSVSLTSAERADEKEKKKHDEYEPVEIQSLTYKRDGKGLLNGSRTQLVLIHLETGEIQQLTDHEADHYGAAFSPDGRQLAFTANLCEPGDAGKPSDVYLMNLADGSLKQITPHRGSFGSCVFSPDGSYIAMLGHENEFRNATLEKAWLYDVKTERLSCLTDMLDVHLSDALIADSIIGGVTPRPVWTNDGQGFYVLGSEQGSTGIYYISIDGLVYPIRLEEEYVNGFAFHPDQKSCIAVIAKPAQPSELYSISLENGEERQLTFYNDRFIEERIISVPEKLQYETKDGLTVNGWFLKPSVFEEDQTYPLILYIHGGPHMMYGHTYFHEFQVLAAQGYAVVYVNPRGSHGYGQDFVNRVRGDYGGGDYRDVMQAVDEAVQAYPFLDSGRLGVTGGSYGGFMTNWIVGQTGRFKAAVTQRSISNWFSFHGVSDIGFFFTDWQLGHDLFEEADKLWDRSPVKYASRVSTPLLILHGERDDRCPIEQAEQLFTALKKLNKTTSFIRFPKATHELSRSGHPEQRMKRIRYICSWFDDYL

SEQ ID NO: 115 - DNA, 477 bp, Bacillus amyloliquefaciens
atgaaaacagcaggcatttacctggcagccggtacaagcagacgcatgggaacggataagcgaagtttatttctcaatggcgtttccctcggaagtatggctcttaaaaatgccttgttatctgaattagatcatatttttgttattacgagaaagggagattcactgcattggctttcggattttttctttttagatcccatgtcaaataagtggagccaggcagaatgtgagcaagcgggtaagggccaaggccattctatacaatgcggtttgcaaaaagcggcagcgtacgaggctgacgccgttatcattctccttgcagatcagccgtttgtcaccgcagatatcatcaatacgttaattgattcctatcaaaaagagcgccgttattcatttatcgccgctgaaaatcagcatcttcctatgcccccattttattctcaaatcaatgtttcccggtattgcatcagttaa

SEQ ID NO: 116 - protein, 158 aa, Bacillus amyloliquefaciens
MKTAGIYLAAGTSRRMGTDKRSLFLNGVSLGSMALKNALLSELDHIFVITRKGDSLHWLSDFFFLDPMSNKWSQAECEQAGKGQGHSIQCGLQKAAAYEADAVIILLADQPFVTADIINTLIDSYQKERRYSFIAAENQHLPMPPFYSQINVSRYCIS

SEQ ID NO: 117 - DNA, 894 bp, Bacillus amyloliquefaciens
ttgctgaaaataggttcacacgtctcaatgagcggaaaacatatgctccttgccgcaagcaaggaagctgtttcgtacggggcgaatacatttatgatctatacgggcgctccccaaaacacgcgccgcaaaaaaattgaagacttgaatatcgaagcgggccgcgcccatatgaaggaaaacggcatcgatgagattgtcgtgcatgcgccgtacatcattaacatcggaaatactacaaatccggcaacgtttgagctgggtgttgattttctgcgttctgaaattgaaagaacggcagcaatcggcgcgaaacagatcgtgcttcatccgggagcgcatgtcggagccggggctgagacgggcatcaaaaaaatcattgaaggtttaaacgaagtgattgttcccggtcaaaacgtgcagattgcgctggaaacaatggcgggcaaaggatcagaatgcggaagaagctttgaagagctggccgagatcattgcgggggttacgcataatgaacatctatccgtctgctttgacacttgccacacccatgacgccgggtatgatgtcgccaatgattttgacggtgttcttaacgagtttgataaaatcgtcggcatcgatcggataaaagtccttcatgtgaatgacagtaaaaatattaaaggcgcccggaaagaccgccatgaaaatatcgggttcggagagatcggttttgacgctctgcagtacatcgttcatcacgagcagcttgccgatattccgaaaatcctcgaaacaccgtatgtaggcgaagacaagaaaaataagaagccgccgtaccgttttgaaatcgaaatgctgaaagaaaagcagtttgatcaggagcttcttgaaaaaatatcagctcaataa

SEQ ID NO: 118 - protein, 297 aa, Bacillus amyloliquefaciens
MLKIGSHVSMSGKHMLLAASKEAVSYGANTFMIYTGAPQNTRRKKIEDLNIEAGRAHMKENGIDEIVVHAPYIINIGNTTNPATFELGVDFLRSEIERTAAIGAKQIVLHPGAHVGAGAETGIKKIIEGLNEVIVPGQNVQIALETMAGKGSECGRSFEELAEIIAGVTHNEHLSVCFDTCHTHDAGYDVANDFDGVLNEFDKIVGIDRIKVLHVNDSKNIKGARKDRHENIGFGEIGFDALQYIVHHEQLADIPKILETPYVGEDKKNKKPPYRFEIEMLKEKQFDQELLEKISAQ

SEQ ID NO: 119 - DNA, 1293 bp, Bacillus amyloliquefaciens
atgatcaggctcgactatttactgaaaaaagacggctatcttttcgctcttatgctgatcaccgtgccgctggcgggggaactgaaattttaccccctgaatgaggtatatcggatcagcttcggcgccccggcttttttcttttttcttctgctgcttcggcatgtgccggcggtattgtcagggctgttgacaggtgcagccgttgtgggattccggatcggcctggcgtgctgggggggagagcatgccggatttacggcggcttttttcagccaatatcccagtttctttttttactttacatatgcctgtttgttttatgtgctgaaggtcaggcttttttgggatcggccgctcatgatcgggtttctcggttttctcattgaaatggcgtccgatgccgttgaaatgacggttcagttttccggcggcaagcagattatgatgccggacaagctggcggatattgcggttatcgctgtttctcacacatttattgtgctgagttttttcaacgtgatgaagctgcacgaatctcaggtcagggaaaaacaaacgagaaagcagcatgagcacatgctgatgattgtgtctaacttatatgaagaaacgattcatctgaaaaaaacgctgaaaacgacggagcatgtgacgaaagaatcctatcagctgtatcgggaaatgagcgggaacgaccgggagctcgggagccgaatgctgcgccttgcgggagaaattcatgaagtgaaaaaagacaatcagcgaatattcgccggcctgtcgaagctgatttcaaatgagagattccgggattacatgaatgccgccgatctggtcggcctcgttatccgcatcaatgaaaaatacgccgaatctttaggcaaagacattcaattcaaaaacgtgattgaaggagaacaccccgattatcacgtctttaccgtcctgtcgatcttaaataacctgaccgccaatgccgtcgaagccatgggtgacaggggtgagatccgcctcgcgctgcgcagggcggagggggggatggccgaatttgaggcggaagatgacggtcccggcattccggaaaaaatcggagaggtcgtttatgatcccggttttacgtccaaatacgatgaattcggcgcaccttcaacgggcatcgggctttcatacgtgaaggaaatcgtaaccgaacttgacggagacatttcctttcataacaagccaaaaggcgtcatatttacgattaagctgccggtgaagcatttgattgcagaaaggatgaactcataa

SEQ ID NO: 120 - protein, 430 aa, Bacillus amyloliquefaciens
MIRLDYLLKKDGYLFALMLITVPLAGELKFYPLNEVYRISFGAPAFFFFLLLLRHVPAVLSGLLTGAAVVGFRIGLACWGGEHAGFTAAFFSQYPSFFFYFTYACLFYVLKVRLFWDRPLMIGFLGFLIEMASDAVEMTVQFSGGKQIMMPDKLADIAVIAVSHTFIVLSFFNVMKLHESQVREKQTRKQHEHMLMIVSNLYEETIHLKKTLKTTEHVTKESYQLYREMSGNDRELGSRMLRLAGEIHEVKKDNQRIFAGLSKLISNERFRDYMNAADLVGLVIRINEKYAESLGKDIQFKNVIEGEHPDYHVFTVLSILNNLTANAVEAMGDRGEIRLALRRAEGGMAEFEAEDDGPGIPEKIGEVVYDPGFTSKYDEFGAPSTGIGLSYVKEIVTELDGDISFHNKPKGVIFTIKLPVKHLIAERMNS

SEQ ID NO: 121 - DNA, 1377 bp, Bacillus amyloliquefaciens
atgggcacaaatgtacaggcggattctttgtctgccgattgtacaaaaacaatgaacggggctctgatgctgattgaatcattaaagaaagaaaatgtcgagatgatcttcggctatccggggggagccgtccttccgatttacgataaactgtatcaatcaggattggttcacatcctgccccgccacgagcaaggcgcgattcatgcggcagaagggtatgcgagagtctccggaaagccgggggttgtgattgctacctccggacccggagcgacaaatttagttaccggtcttgcggatgcgatgattgattcactgccgctcgtagtgtttaccggtcaggtcgccacttcggtcatcggcagcgacgctttccaggaagccgacattttaggaattacgatgccgattacgaaacacagctaccaagtccgccgtccggaagatctcccccgtgtgattaaagaggcgttccatattgccacgacgggaagaccgggcccggtattaattgatataccgaaggatgtcgcagcatttgaaggagaattcagatatgatcacgagatcaatcttccgggttatcagccggtaaaagagcctaactatctgcagatccgaaagctcgtggaagctgtcagcagtgcgaaaaagccggttattttagccggagcgggtgttttgcacggtaaagcttcagaagatttaaaaaattatgccgaacagcagcaaattccggtagcgcacacgcttctcggtctgggcggtttcccggcagaccatcctctttttctgggaatggcggggatgcacggcacatacacagcgaatatggcgctttaccactgtgacttgctgatcagcatcggagcgcggttcgatgatcgcgtgaccggaaatctgaagcattttgcaaaatcggccaaagtagcgcatatcgatattgatcctgctgaaatcggaaaaattatcgaaacgcagattccggtggtcggcgacagtaaaatcgtccttcaggaattattgaagcaaaacggaaaacagggacagacagaggaatggaaacagcagctttcagaatggaaagaagaatatccgctttggtatacagacgacagagaagagggcttgaaaccccaaaagctgattgagtatattcaccaattcacaaacggtgaggcgattgtggcgacggatgtcggccagcaccagatgtgggcggctcagttttatcctttccgaaaggctgataagtgggtgacctcggggggctcggcacaatgggcttcggccttccggcggccatcggagcgcagctggccgatcgtaacgccacggtcgttgccatcctcggagacggcggttttcagatga

SEQ ID NO: 122 - protein, 458 aa, Bacillus amyloliquefaciens
MGTNVQADSLSADCTKTMNGALMLIESLKKENVEMIFGYPGGAVLPIYDKLYQSGLVHILPRHEQGAIHAAEGYARVSGKPGVVIATSGPGATNLVTGLADAMIDSLPLVVFTGQVATSVIGSDAFQEADILGITMPITKHSYQVRRPEDLPRVIKEAFHIATTGRPGPVLIDIPKDVAAFEGEFRYDHEINLPGYQPVKEPNYLQIRKLVEAVSSAKKPVILAGAGVLHGKASEDLKNYAEQQQIPVAHTLLGLGGFPADHPLFLGMAGMHGTYTANMALYHCDLLISIGARFDDRVTGNLKHFAKSAKVAHIDIDPAEIGKIIETQIPVVGDSKIVLQELLKQNGKQGQTEEWKQQLSEWKEEYPLWYTDDREEGLKPQKLIEYIHQFTNGEAIVATDVGQHQMWAAQFYPFRKADKWVTSGGSAQWASAFRRPSERSWPIVTPRSLPSSETAVFR

SEQ ID NO: 123 - DNA, 519 bp, Bacillus amyloliquefaciens
atgaaaacaaaagaattagtcattatggccctgtttgcggcaatcggagcggtgcttcattccattatgccgccggtattattcggaatgaaacccgatatgatgcttgtgatgatgtttatgggtattctgttatttccccgtgtgcagaacgtgctgatgatcgggattgtaacgggaatcatttccgcactcacgacatcttttccgggcggacagcttccgaatatcattgaaaaaccggtaacggcgtttctgtttctcgcgctggcgcttttggtgaaaaagagcgtgaaaacagcggccgccgccgtcattacaatagccggcaccttcatctccggtttgctctttctggcgctggcccttctgattgtcggcctgccggggggattcaccgccttggtgctcgcggtcgtccttccggcggctgcgctgaatgcgatcgccattatcattatgcatccgattgtgcagacgatcttaaaacggtccaatatgattgaaacggtgaaataa

SEQ ID NO: 124 - protein, 172 aa, Bacillus amyloliquefaciens
MKTKELVIMALFAAIGAVLHSIMPPVLFGMKPDMMLVMMFMGILLFPRVQNVLMIGIVTGIISALTTSFPGGQLPNIIEKPVTAFLFLALALLVKKSVKTAAAAVITIAGTFISGLLFLALALLIVGLPGGFTALVLAVVLPAAALNAIAIIIMHPIVQTILKRSNMIETVK

SEQ ID NO: 125 - DNA, 849 bp, Bacillus amyloliquefaciens
atgaacgaaaaaaaagagaaaatcataaaaacaggcatccatttatttgccaaaaaagggttttcttcaacaaccattcaggaaatcgccggtgaatgcggaatttcaaaaggggccttctatcttcattttaaatcaaaagaagaccttttgctctcagcatgtgagtattacatcggcatgtctatggaagaaataaagaaaatcaaaacagaacatcagcataaatcgcctaaggacgtattccgaaaacaaatcgcttatcaattccaggaatttatggagcacaaggactttatcattctcttgctgagcgaaaaggtcattcctgaaaatcaaaaggtcaaacagtattttcatgaggccaatattcaatttaacatactgtaccgggatgctttgctctccgtttacagagatgccgtcataccgtttatagcggatgcgtccgttatggcgcaaggaatagtgagctcctatattcatttcttgatttttaatgaacatacggcattccggacggaaaacgtggcggcctttctgattgccagaatcgatgacctgattacgggactgataagagacaatcccgatccgctgctgccgcaggatatcttcactcagccggcggcggacagagaaagactgcttgcggatattcaaaagataaaagcacagcaggggctgcctgaggacgtcctcgtatcgcttgaagtcattgaagaggaatacgcaaaggaagagccgcgaaaaccgattattaaaggaatgctgtccaacttggcaggcagcggaaatgagcagattgaaacgctgcgggcttccattgaaacctatttcagcttataa

SEQ ID NO: 126 - protein, 282 aa, Bacillus amyloliquefaciens
MNEKKEKIIKTGIHLFAKKGFSSTTIQEIAGECGISKGAFYLHFKSKEDLLLSACEYYIGMSMEEIKKIKTEHQHKSPKDVFRKQIAYQFQEFMEHKDFIILLLSEKVIPENQKVKQYFHEANIQFNILYRDALLSVYRDAVIPFIADASVMAQGIVSSYIHFLIFNEHTAFRTENVAAFLIARIDDLITGLIRDNPDPLLPQDIFTQPAADRERLLADIQKIKAQQGLPEDVLVSLEVIEEEYAKEEPRKPIIKGMLSNLAGSGNEQIETLRASIETYFSL

SEQ ID NO: 127 - DNA, 534 bp, Bacillus amyloliquefaciens
atgacaccatttacgattacggaggagaaggcgggggcattccgggtcacctccgcccggaaggatgatgaagaagaagtcatggatctgctcgtgcaggcggcagaatggcttcgcgataaagggtcgaaccagtggagcggccttctgcaaggggaagatacccacaatatgcgggaggcgatcgccaaagggtatgtttttttattcaggcagaatgaagagctggccggcgtcgtcatgctgcttcccgaagcaagcgggtgggacagacgtctatggggcgatgaaggacatgaggagtccgtatatctccaccggctggcgattaacaggcggtttgcaggggcggggctcggccggacgatcatgacttgggcggagacgggggtgtcttgtcctggaaaaacgaaaatccggctcgactgcgtgtccggaaacaaggcgcttcagtcgttttacagcggaatgggttacgaatcaaaaggactcgcgccgggttatcatttgtttgaaaaaaaggtgagcaaataa

SEQ ID NO: 128 - protein, 177 aa, Bacillus amyloliquefaciens
MTPFTITEEKAGAFRVTSARKDDEEEVMDLLVQAAEWLRDKGSNQWSGLLQGEDTHNMREAIAKGYVFLFRQNEELAGVVMLLPEASGWDRRLWGDEGHEESVYLHRLAINRRFAGAGLGRTIMTWAETGVSCPGKTKIRLDCVSGNKALQSFYSGMGYESKGLAPGYHLFEKKVSK

SEQ ID NO: 129 - DNA, 1122 bp, Bacillus amyloliquefaciens
atgattgcccttcatttcggagcgggaaacatcgggcggggctttatcggcgccctgctccatcattccggctatgacgtagttttcgctgatgtgaatgaaacgatggtcagccttctcaatgaaaagaaggaatataccgtggagcttgccgacggcggcaggcagacagaaatcatcggccccgtttcagccatcaacagcgcggtgcaagaacaagagctgtacgggctgatcaatgaagcggcgatcattacgacggcggtgggcccgaacgttctcagactcatcgccccgtccatcgcggaaggtctgaagcgcagaacgtcctctgagcctctcaatatcattgcctgtgaaaatatgatcggcggcagcagttttctgaaaaaagaagttttcggacatttgacggaagcggagcgggaactcgtgaaccggacagtcggcttcccggattctgcggtagatcggatcgtgccgattcagcaccatgaagatccgctgaaagtatccgtagaaccgttttttgaatgggtcatagacagaaccggctttgccggcgatcagccggtacttaaaggcgcgttgtttacggatgatcttacgcctttcattgagagaaagctgtttaccgtcaataccgggcatgccgtcacggcgtatgtcggctatcagcgcggattaaaaaccgtcaaagaggccatcggccatccggaaatccggcgtgtcgtgtacgatgcactttcagaaacgggcgagtacttggtgaaagcgtacggctttaagcaagccgaacacgagcagtacatgaaaaaaatcatcagccgctttgataatgaatacatcacggatgatgtgacaagagtcgccagatcaccgctcagaaaactcggagcgaatgacagattagtagggccggccaaaaaaataaaagaaccgaatgcgctggcggaaggtatcgccgccgccctgcgctttgactatcaggatgatccggaagcggttgagctgcaaaagcttatcgcggaaaaaggcacgagcggcgttcttcaagacatttgcggtattcagccgcatgaaccgctgcacggcatcgtgctcaaaaagctcaatcaataa

SEQ ID NO: 130 - protein, 373 aa, Bacillus amyloliquefaciens
MIALHFGAGNIGRGFIGALLHHSGYDVVFADVNETMVSLLNEKKEYTVELADGGRQTEIIGPVSAINSAVQEQELYGLINEAAIITTAVGPNVLRLIAPSIAEGLKRRTSSEPLNIIACENMIGGSSFLKKEVFGHLTEAERELVNRTVGFPDSAVDRIVPIQHHEDPLKVSVEPFFEWVIDRTGFAGDQPVLKGALFTDDLTPFIERKLFTVNTGHAVTAYVGYQRGLKTVKEAIGHPEIRRVVYDALSETGEYLVKAYGFKQAEHEQYMKKIISRFDNEYITDDVTRVARSPLRKLGANDRLVGPAKKIKEPNALAEGIAAALRFDYQDDPEAVELQKLIAEKGTSGVLQDICGIQPHEPLHGIVLKKLNQ

SEQ ID NO: 131 - DNA, 102 bp, Bacillus amyloliquefaciens
atgtacctgtttttttattccataaaaaatctcagaatcgaaataaaatcattgactttatataaaaaagaaagtaacatactatttgtaagtaaatattaa

SEQ ID NO: 132 - protein, 33 aa, Bacillus amyloliquefaciens
MYLFFYSIKNLRIEIKSLTLYKKESNILFVSKY

SEQ ID NO: 133 - DNA, 1062 bp, Bacillus amyloliquefaciens
gtgtcacagcctaatatgcccaatatcacccctgtcgttacactttccagagacgataccattaaccttcttctttcgtcaattgctatggaagagctgggaatggcacatattctgaatgcggaaggggaaaaaatccaatacgcgctcggaacgattcccggattaacaggacccccgtcaagtcttgcggatattcttaacctgaatgagagcgtccgggatacgcttgacagcttaatgaaacaggagctccttctcggttcaaaattggacagtatctcaaatatccctacattggcgggaccgacgggggccacggggccgacgggggccacgggtgcgggtcttcaagggattgttgcttttaatccgctgatcgcccctacttacacgaccggacaggttgtcttgtataacggcagctcttatgtcgcaaacgtaaacagcccgtcgggaacccctgaaacctcagctgactatacacttttagctgcggcgggaagcaccggcgctactggttcaaccgggcggaccggaattaccggggctactggcggcactggatcaactggaattaccggcgttacaggaccgaccggagttaccggggctaccggcattacagggcctccgggaagcaccggaacaagtctgacagccacttccggctatgcgagcaatacgggcggcggtgttgtcgcagttattaacggcggcacggccatttccttaccgaatgaacaaaacctctcagcggatattaccgctaatgccgcaaatactgtattcaccgttgctccggcaggacggtactatatttcctaccatattaatttaacggccggcctgctagtaagttcgcgcatcttaatcaacggcactccggctgcaagttcgattattgctccggtcgcgtctttggcaaacttcaataactcctttattgtgactttgacagcaggcagcaccattcagctccagctgttcggattattgggtgcggccacattgcttagaggaagtgccggcgcagctttaaacattattcgattatcttaa

SEQ ID NO: 134 - protein, 353 aa, Bacillus amyloliquefaciens
MSQPNMPNITPVVTLSRDDTINLLLSSIAMEELGMAHILNAEGEKIQYALGTIPGLTGPPSSLADILNLNESVRDTLDSLMKQELLLGSKLDSISNIPTLAGPTGATGPTGATGAGLQGIVAFNPLIAPTYTTGQVVLYNGSSYVANVNSPSGTPETSADYTLLAAAGSTGATGSTGRTGITGATGGTGSTGITGVTGPTGVTGATGITGPPGSTGTSLTATSGYASNTGGGVVAVINGGTAISLPNEQNLSADITANAANTVFTVAPAGRYYISYHINLTAGLLVSSRILINGTPAASSIIAPVASLANFNNSFIVTLTAGSTIQLQLFGLLGAATLLRGSAGAALNIIRLS

SEQ ID NO: 135 - DNA, 282 bp, Bacillus amyloliquefaciens
atgcattacataacggcatgcttaaaaatcatcagtgataaagaccttaatgaaataatgaaggaattcaaaaaacttgaggaagaaacgaacaaagaagaaggctgtattcagttccatgctcatccgcttgaaccatcagaacgcaaaattatgctttgggagatttgggaaaacgaagaagctgttaaagtccattttacgaaaaagcacacaaaagacgttcaaaaacaagaattaacggaagtagaatggttaatgaaaagcaatgtgaatgagtaa

SEQ ID NO: 136 - protein, 93 aa, Bacillus amyloliquefaciens
MHYITACLKIISDKDLNEIMKEFKKLEEETNKEEGCIQFHAHPLEPSERKIMLWEIWENEEAVKVHFTKKHTKDVQKQELTEVEWLMKSNVNE

SEQ ID NO: 137 - DNA, 2403 bp, Bacillus amyloliquefaciens
atgaatgactgtgtcaaaacattcggagaacttccggccgaactttattcctttgcgggaggaaaaggaagcattctctctaaaatgtatcaaagcgggtatcctgtgcctgaagggtttgtgattttgccgtcagcctttcaggacggacagctccgccatcaggcgagagaggctgttgatcaatatgtgaattccatccgcagccgccatgcatctgcgttgtttgccgtacgctcatccgcgctgagcgaggattccgctcaggcttcctttgccggagaattcgatacggtgttgaatgtcagaacagatcaagacatgtccagggcgattgatgaagtccgccggtcggtacagtcagaaagagtaaaagcgtacagcgccgttcagggaatggaagatgagcatgaaatcgcaatcgtcatccagctgatgataccgtctgagatatccggagtgctgtttaccgcagatccgattacggggagcaggcgggagatgacaggcaattacgtctacggtctcggggagcagctcgtttccggggaagccgatgcctattcttttaaactggcacggcccaagaaaaaatatgacggccccggggaatttcgcaaatatgcgtcaaagctctataaactggcgaaaaagctggaaaaagatcttggagggccgcaggatattgaatgggccgccgcgggcgggacattgtatattcttcaatcccgcccgattacgaccttacaagccggaaatctggaaacctatgaatggaacgattctttcagcggtgattttttatggacaaacacaaatataggagaagcgattcccgatgtgatgacgccgctgacatggtcgctcctccggaatctggatgaagagtcgggcatcattccgggctattatgtctggtccggcaatatttgcggcagagcctataacaatatgagccagcctctttccgttctcgccgctttcggtctgaatccgaaaggcggaaaaattggaaaaatgatgagcgatacattgggagaaatcccggcggaaatgaagatacctttatatccgttctcaaagtatgaattattgaagatcatcccgaaaaaactgaaaccgtatctgtcgaaaatgaagcaagcgaaaaaaaacatgtcctcctacttggacgaatcaccggagtggtgccggaatattgaggaaaagctgaaacgcgccgaaacggagcaggcattattagcgatatggaacgatgagatctatccgtatttatgcaacgcgtggtttgcgttaatatccggcgggcgtgattctgcgcaatcctcttcgtcgttaacctctcaattaacaaaactcgcaggcatagaagatgcgaatctcctgctttccaatctgaggggaaaaggcggactggccagcctggagccgattatcggcattgatcaagtcatgaaaggccgtatgagcgaggaagaatatctcaggaaccagggccaccgtggcccgcatgaatacgaactttccataccgcatccgggagaaaaccgggattggctgacgaagcagatcaaagaacacaaggagtcgggtattgatgccgaacaactgcttttgaaacagcagcgggcgcatgaacaggccttccgaagatttgaaaaaaagtttcctcataaggtcaaatggctcaaagccaaaatggaaaaagcgtcagaatacgcgaatattagagaaacaaccagatccgaatttgtcagagtgtaccggacagccagagcattcgcgctcagagcggcggaaatgaccggcatgaaggacgatattttcttcctgtatctgcatgaaataaccgatctgctcgcggggaaagagccggcggttgcgtcgattcaagcgagaaagcaaaactatgaaacctataaaaaactgccgccgtttccatccgttattaacggaagattcaatccgtttaaatgggctgaggatcctgacagaagagcggattattacgatgcttttatgcctgcggaaacggatgatgcgcatactttaaaaggtttcgcgggagcggccgggagagtggagggcattgtccgtgtccttgatgctccggaagacggtgattcttttgcggcgggggaaattttagtgacgtcgacaaccaatgtaggctggaccccgctttttccaagagcggctgccatcataacggacgtcggcgcccctttgtcccacgcggcgatcgtcgcccgggaactggggattcctgccgttgtcgggtgcggaaatgcaacgtcaaaactgaaaacggggacagggtggccgttgacggcgggcaaggcatcgtccagctggaaccgcggcagactccggtcacttctgaagaggaaaatggtaaactga

SEQ ID NO: 138 - protein, 800 aa, Bacillus amyloliquefaciens
MNDCVKTFGELPAELYSFAGGKGSILSKMYQSGYPVPEGFVILPSAFQDGQLRHQAREAVDQYVNSIRSRHASALFAVRSSALSEDSAQASFAGEFDTVLNVRTDQDMSRAIDEVRRSVQSERVKAYSAVQGMEDEHEIAIVIQLMIPSEISGVLFTADPITGSRREMTGNYVYGLGEQLVSGEADAYSFKLARPKKKYDGPGEFRKYASKLYKLAKKLEKDLGGPQDIEWAAAGGTLYILQSRPITTLQAGNLETYEWNDSFSGDFLWTNTNIGEAIPDVMTPLTWSLLRNLDEESGIIPGYYVWSGNICGRAYNNMSQPLSVLAAFGLNPKGGKIGKMMSDTLGEIPAEMKIPLYPFSKYELLKIIPKKLKPYLSKMKQAKKNMSSYLDESPEWCRNIEEKLKRAETEQALLAIWNDEIYPYLCNAWFALISGGRDSAQSSSSLTSQLTKLAGIEDANLLLSNLRGKGGLASLEPIIGIDQVMKGRMSEEEYLRNQGHRGPHEYELSIPHPGENRDWLTKQIKEHKESGIDAEQLLLKQQRAHEQAFRRFEKKFPHKVKWLKAKMEKASEYANIRETTRSEFVRVYRTARAFALRAAEMTGMKDDIFFLYLHEITDLLAGKEPAVASIQARKQNYETYKKLPPFPSVINGRFNPFKWAEDPDRRADYYDAFMPAETDDAHTLKGFAGAAGRVEGIVRVLDAPEDGDSFAAGEILVTSTTNVGWTPLFPRAAAIITDVGAPLSHAAIVARELGIPAVVGCGNATSKLKTGTGWPLTAGKASSSWNRGRLRSLLKRKMVN

SEQ ID NO: 139 - DNA, 1563 bp, Bacillus amyloliquefaciens
atgtctaagcaaggaaacttccagaaaactatgtcactttttgatcttattttaatcggcatgggagccatattcggttcggcatggctgtttgccgtcagtaacgtcgcctctaaagcgggcccgtcaggcgttttttcctggctgatcggcgggggaatcatcttattgatcggcttggtttatgcggaactgggcgccgcgctgccgcggaccgggggaattatccggtatcccgtatattcacacggacacctggtcggatatttaatttcctttgtcaccattgtggcatacacgagtcttatttctatagaagtaacggcggtccgccaatacgtggcgtattggtttcccggtttgaccgtaaaaggctctgattctccgacaattgccggatggatattgcaatttgcgctgctctgcctgttcttcctcctcaattactggagtgtcaaaacctttgcgaaagcaaacttcattatttcgatttttaaatatgtcgtaccgattacggtaattgttgtactgatttttcattttcacccgggcaatatgaccgttcacggattcgcgccttttggtttcaccggaattcaggccgcgatttccacaggcggcgtcatgtttgcataccttgggctgcatccgattgtggctgtcgcgagtgaagtgcagaatccgaagcggaacattccgattgcattgattgtttgtattatcgtttctactattatttataccgtgctgcagctcacttttatcggggcgatcccgggggataccctgaagcacggatggccggctatcgggactgaattctcccttccgttcaaagatatcgccgtcttgctcggtttggggtggctggcgacattggtcattttagatgcgattttatcaccgggcggtaacggaaatatctttatgaatacgacttcacgtctcgtctatgcctgggccagaaacggaacattattcagcattttttctaaagtcaataaagaaaccgggacaccgcgtgcctccctttggctttcgttcggtctggctgttttttggacgcttccgttcccttcttggaacgctcttgttaacgtatgctccgtcgcattgattctgtcttatgcgattgcgccgatttcttctgcggcgctgagagtcaacgcaaagaacattaacagaccgttttatttaaaagggatgagcatcatcgggccgctgtcgtttatttttacctcttatattgtatattggtccggatggcgcaccgtatcctggcttctcggttctcaaattgtcatgtttctgatctatctctgtttcagtaaatatgctcccaaagatgatgtcagcatacgccagcagctgaaatcagcatggtggatcgtcggcttttatgtcatgatgctgattttctcctatctcggctcgttcggccacggattgggcattatcagcaatccgcttgacctgattctgatcgccatcggttcgctcggtatttattactgggcaaaatatacaggtctgccgaaggctatgatcgacagtgataaatga

SEQ ID NO: 140 - protein, 520 aa, Bacillus amyloliquefaciens
MSKQGNFQKTMSLFDLILIGMGAIFGSAWLFAVSNVASKAGPSGVFSWLIGGGIILLIGLVYAELGAALPRTGGIIRYPVYSHGHLVGYLISFVTIVAYTSLISIEVTAVRQYVAYWFPGLTVKGSDSPTIAGWILQFALLCLFFLLNYWSVKTFAKANFIISIFKYVVPITVIVVLIFHFHPGNMTVHGFAPFGFTGIQAAISTGGVMFAYLGLHPIVAVASEVQNPKRNIPIALIVCIIVSTIIYTVLQLTFIGAIPGDTLKHGWPAIGTEFSLPFKDIAVLLGLGWLATLVILDAILSPGGNGNIFMNTTSRLVYAWARNGTLFSIFSKVNKETGTPRASLWLSFGLAVFWTLPFPSWNALVNVCSVALILSYAIAPISSAALRVNAKNINRPFYLKGMSIIGPLSFIFTSYIVYWSGWRTVSWLLGSQIVMFLIYLCFSKYAPKDDVSIRQQLKSAWWIVGFYVMMLIFSYLGSFGHGLGIISNPLDLILIAIGSLGIYYWAKYTGLPKAMIDSDK

SEQ ID NO: 141 - DNA, 378 bp, Bacillus amyloliquefaciens
atgagaagtttttttgtcacaggaacagataccggcgtcggaaaaaccatcgtttcttgcggacttgccgcggcattcaggcagaaacaggcggatatcggagtgtttaaaccgtttttaagcggcgtgccgcggactcatccggaaagtgacacctcgctgttgaaaaacatgtcacaaaccgcactgtctcatgaagaaatcacgccatttgaatggaaagagccgcttgcgccgtacacggccgccatgcttgaggggaaatccgtgagcatggatgaagtcatggcccactggagtaagatcaaaaatcgtcatgagtgtttcatcgtcgaggggcaggcggcatttccgttccgcttggtgaaaattacttag

SEQ ID NO: 142 - protein, 125 aa, Bacillus amyloliquefaciens
MRSFFVTGTDTGVGKTIVSCGLAAAFRQKQADIGVFKPFLSGVPRTHPESDTSLLKNMSQTALSHEEITPFEWKEPLAPYTAAMLEGKSVSMDEVMAHWSKIKNRHECFIVEGQAAFPFRLVKIT

SEQ ID NO: 143 - DNA, 1449 bp, Bacillus amyloliquefaciens
atgagcgctccagaagaaaaaaagatgagaaagcttcctaagtacatacaaatcattcaatttataaaagagaaaataggaaatggagaatggccgatcggaagtaagattccaagccagcgcacgcttgccaaacactttgaggtgaacaggagcacagtcattacagctttagaggaattgacggcggatggattaatcgaaggcagaatgggcaaagggacagttgttacgaacaatacatggacacttttggctaagaattccgctcccgattgggatcagtatgtaacctccggaattcagcagccaagccaaaaaatcgttcaagagatcaataaatcagaatcaaattctgatcttatacagctcagtaaaggagaactttcacatgagatttttcctttagctgttatgaaagagatcatgggaaaggtatcccaaaacatagaggcattcggatatgaggaaccaaaaggatatttgcctttgagagaggcattaagcggctatttaagaacaatcggcattcaagcttctccttcttccattcttattgtttcgggcgcactgcaagccttacagcttatatcaatggggcttttacaaaggggatcgaccgtttatcttgatcagccttcctatctttattcattacacgtatttcaatcagccggtatgaagctgactggagttcctatggatcatgatggacttttgccggaacatatccgcatggcaaggggagaacgggggagggctatcttatatacaaatccttgttttcataatccgacaggtattttaatgtcaaaaaagagacgagaagaaatccttgcggcaagtgagaatacacagcttcccattattgaagatgacatttatcgtgagttatggatagatgagattcccccggatcctattaaaacaatagataaaaatgggcatgtgctttacataggcagtttatcgaaaacattaagtccgggcttgaggattggctggattgtcgggccggaaccagtgattgaacgtttatccgacataaaaatgcaaacagattacggctccagttcgttatcccagagagtagcggcagagtggtttatatccggtgaataccagcagcatctagaacaggtgagaagtcaattaaaggtgagaagagaattggccttgagtgttttagaaactcatttgaaagatgtggcgacatggaatatcccaaagggaggattctttgtctgggtaaaaatattgccttccatatccgtgaaattactttataccaaagccttatcaaaagggattctgctcaatctcggcaggatctatgctgaggaaaaagggagttatattcgcttatcatatgcttatgcatctcttgaagaccttcaaaagggaatttatgaattgggtttgatgattaaggaattggcaagcagataa

SEQ ID NO: 144 - protein, 482 aa, Bacillus amyloliquefaciens
MSAPEEKKMRKLPKYIQIIQFIKEKIGNGEWPIGSKIPSQRTLAKHFEVNRSTVITALEELTADGLIEGRMGKGTVVTNNTWTLLAKNSAPDWDQYVTSGIQQPSQKIVQEINKSESNSDLIQLSKGELSHEIFPLAVMKEIMGKVSQNIEAFGYEEPKGYLPLREALSGYLRTIGIQASPSSILIVSGALQALQLISMGLLQRGSTVYLDQPSYLYSLHVFQSAGMKLTGVPMDHDGLLPEHIRMARGERGRAILYTNPCFHNPTGILMSKKRREEILAASENTQLPIIEDDIYRELWIDEIPPDPIKTIDKNGHVLYIGSLSKTLSPGLRIGWIVGPEPVIERLSDIKMQTDYGSSSLSQRVAAEWFISGEYQQHLEQVRSQLKVRRELALSVLETHLKDVATWNIPKGGFFVWVKILPSISVKLLYTKALSKGILLNLGRIYAEEKGSYIRLSYAYASLEDLQKGIYELGLMIKELASR

SEQ ID NO: 145 - DNA, 276 bp, Bacillus amyloliquefaciens
atgaacagacaagaattgattgcagaagcattaaaagcacgggacacagcgtatgtgccgtattcaaatttcagagtgggagccgctcttcttaccaaagacggaaaagtgtacagaggctgcaacattgaaaatgcggcatacagcatgtgcaactgtgctgaacgcacggcgatattcaaagctgtttccgaggggatacggaatttgcgatgctcgccgtggctgcggatactccgggaccggtttcgccgtgcggagcctgcagacaagtaa

SEQ ID NO: 146 - protein, 91 aa, Bacillus amyloliquefaciens
MNRQELIAEALKARDTAYVPYSNFRVGAALLTKDGKVYRGCNIENAAYSMCNCAERTAIFKAVSEGIRNLRCSPWLRILRDRFRRAEPADK

SEQ ID NO: 147 - DNA, 219 bp, Bacillus amyloliquefaciens
atggaaaaacaaaccctcagccatccgattggagagtatcagccggctgaatcgatttcggccggacagaaacaagaatggatcaatgcgctggaacacgctccggctaaactgaaccaagctgtcagagcgatgtcggccagtcagcttgatacgccgtaccgcgaaggggatggactgtccgccaagtggttcaccatctggcggacagccacatga

SEQ ID NO: 148 - protein, 72 aa, Bacillus amyloliquefaciens
MEKQTLSHPIGEYQPAESISAGQKQEWINALEHAPAKLNQAVRAMSASQLDTPYREGDGLSAKWFTIWRTAT

SEQ ID NO: 149 - DNA, 684 bp, Bacillus amyloliquefaciens
atgcttttccggcagcattttaaacctgtcgatattcacggtcatctgccgtacagccttaatttcggcaaaaacgataagacattttccgattataaccgggagcggtcggaaagaatgaatctcacttgggattttcctgatccgcatgatgttgatggcgatgacggcgaaatcgctttgatgacaagatgggagaaagaattagataagtacggcattgacgtgctgaattttttaacagcagagagcaatgaccggatggcggcgtttattcaagccaatcccgcgaggtttaccggatttgcatatcatcctttggaacaaaaggatgcgtatgaggagctgaaaagagcggttgaagagctcggtctgaaaggatataaactgttcgggccgctgacagacatcgagtttcatgatccgtcgctgaaaaagctgtggacgtatctggctgacaaaagactgcctgtattaattcacttcggacttttagggagagcgggggcattgtcagccatcgcaacatcaacccgctctccatctatcgcgtcgcgagagagtatgctgatataccgttcatcattccgcatttcggcgccggatattatcaggaactgctgcagctgtgctggagctgcccgaatgtgtatattgacacgtccggctcaaatcagtggatga

SEQ ID NO: 150 - protein, 227 aa, Bacillus amyloliquefaciens
MLFRQHFKPVDIHGHLPYSLNFGKNDKTFSDYNRERSERMNLTWDFPDPHDVDGDDGEIALMTRWEKELDKYGIDVLNFLTAESNDRMAAFIQANPARFTGFAYHPLEQKDAYEELKRAVEELGLKGYKLFGPLTDIEFHDPSLKKLWTYLADKRLPVLIHFGLLGRAGALSAIATSTRSPSIASRESMLIYRSSFRISAPDIIRNCCSCAGAARMCILTRPAQISG

SEQ ID NO: 151 - DNA, 351 bp, Bacillus amyloliquefaciens
gtgaaacatcataaaacgtaccattcttcatcaattcagacagcagccggccctctattggtagaagggcccgttcctccaaaggacctagcacagtatgagtttcatgaaggcctgacagcctttcgccttcctcatgaacagcacaaagcgttaatcgagatcgccgggcttcctgaaggtcggatcattatcgccagggacggacagacgattatcggctatgtgacgtatttatatcctgatccgcttgaacggtggtctgacggcaatatggaagatctccttgagctcggggcgatcgaggtcgctcccggctacagggctgttctgtcggaaaaacgttgctga

SEQ ID NO: 152 - protein, 116 aa, Bacillus amyloliquefaciens
MKHHKTYHSSSIQTAAGPLLVEGPVPPKDLAQYEFHEGLTAFRLPHEQHKALIEIAGLPEGRIIIARDGQTIIGYVTYLYPDPLERWSDGNMEDLLELGAIEVAPGYRAVLSEKRC

SEQ ID NO: 153 - DNA, 1188 bp, Bacillus amyloliquefaciens
atgaaacatgaacatgcagccgttgtactagatttcagtgcaaacgggattgggatcattcgcagcctggcccgaagaggaatcgatgtttacgcatttgacacggagggaccttatcgtatcggaaaatcaagattggcagattgcgggatatgtcccagccctttaacacaagaggaagaactgctgacattcctgactgatttcgggaagcgattccaagcaaagccggttctgtatgcaggttctgatgattatgcgggatttatatctaaattccgcgagacattagccggtttttttttatttttgctcccgagccgctctctgttagaaacggtcttagataaaagcaaagcatatgaattagcggtcaagcataacatcccctgcccgaaaaccttttttccgaacaaccgggatgagctggaagaggccatcgccaatattgacttcccgtgtattttaaaaccggtggccggccatgaatacagaaaaaaagtaaacaaaaaagcaattgtaatgaaggatgccgcacaattgcgcaaggagttcagctcctacagagaaaatggagaactgctcgtgcaggagatcatccccggagacaaccagtgtttttataaagtcgccactttttatgatgaccaaatgaaattaatgggcttattctctctgcaaaagaaccatcaattccctgctgattttggcgcgggggcccacgtcgtcagcaaacggcttcctgatttaatcgagaagaccctgccgttttttgaagcgattcagctgaagggagtaggcatggcagaatttaaaaaggacccccgggacaatgtttataagtttatcgaaattaatccgcgcttttggctcagccatagcctgacagaaccggcaggcattcatttcgtttacatgtactatctgtatttgaccggacaacatgtgaagccccagctcgaacaaaaagacggaatcaactggatttatgaggtgcgttacttcttaacgtttttgaagaaacgaaaaagaggagaaatgacgttccgggatttttggaaaggatttaaaggaaaaaaagagtacgctctgtttgcttggaatgacccgatgccatttatcagaaacacttggtctcatctcaaaaacagctggaaacggaagcggaaggaagatcggcatgtatga

SEQ ID NO: 154 - protein, 395 aa, Bacillus amyloliquefaciens
MKHEHAAVVLDFSANGIGIIRSLARRGIDVYAFDTEGPYRIGKSRLADCGICPSPLTQEEELLTFLTDFGKRFQAKPVLYAGSDDYAGFISKFRETLAGFFLFLLPSRSLLETVLDKSKAYELAVKHNIPCPKTFFPNNRDELEEAIANIDFPCILKPVAGHEYRKKVNKKAIVMKDAAQLRKEFSSYRENGELLVQEIIPGDNQCFYKVATFYDDQMKLMGLFSLQKNHQFPADFGAGAHVVSKRLPDLIEKTLPFFEAIQLKGVGMAEFKKDPRDNVYKFIEINPRFWLSHSLTEPAGIHFVYMYYLYLTGQHVKPQLEQKDGINWIYEVRYFLTFLKKRKRGEMTFRDFWKGFKGKKEYALFAWNDPMPFIRNTWSHLKNSWKRKRKEDRHV

SEQ ID NO: 155 - DNA, 624 bp, Bacillus amyloliquefaciens
atgatgaacgacgctttaacgagtttggcatgtagtctggcaccggggacggcaattcagggcaaatggaacggcaaatcctacagattgctcaaacagcttggaaaaggggctaacggtattgtatatctggcagaagcatcaggcggacaggtcgctttgaaaataagcagcgacagcatgtctgttacctctgaagtgaatgtcttaaaatccttttcaaaggcccggtcgcaaacgatggggccttctttttttgatgcggacgatgcgtttattccgcagctgaataaaaatgtctctttttacgtgatggagtacatagaagggccgcttcttccgcaatatatcagcagtaagggagcggagtggattccggtgctgatggtgcagcttctttccagcttgtcagtccttcatcagcagggatgggtttttggcgacctcaaaccggaaaatcttattgtaaccggaccgccggctgccatccgctgcattgatgtagggggaacgacaaaacaaggccgcgcgattaaagagtatacggagttttacgacagggctattgggggtatggaacaagaaaagcagaaccatcctatgacctgtttgctgtcgcaatga

SEQ ID NO: 156 - protein, 207 aa, Bacillus amyloliquefaciens
MMNDALTSLACSLAPGTAIQGKWNGKSYRLLKQLGKGANGIVYLAEASGGQVALKISSDSMSVTSEVNVLKSFSKARSQTMGPSFFDADDAFIPQLNKNVSFYVMEYIEGPLLPQYISSKGAEWIPVLMVQLLSSLSVLHQQGWVFGDLKPENLIVTGPPAAIRCIDVGGTTKQGRAIKEYTEFYDRAIGGMEQEKQNHPMTCLLSQ

SEQ ID NO: 157 - DNA, 1152 bp, Bacillus amyloliquefaciens
atggcaaatgaaacgtatgaatcattaaacaaacgtttaatcaatatccgccgcgaccttcatgaacaccctgagctgtcaggcgaggaattcgaaacgacgaataaaatccgccgctggctggaggaagaaggaatcacggttcttgatgtgccgaaacttcaaaccggagtgatcgctgaaatcaaaggagataaaagcggccccgtcatcgccgtcagagcggacatcgacgcactgccgatcgaagagaaaacaaaccttccgtttgcttcgcgcaacagcggcgtgatgcacgcatgcggccatgatttccatacggcatctatcctcggcacggctttcttattaaatgagagaaagcatgagctgaaaggaacggtgcggtttatttttcagcccgcggaagaaatcgccgccggagcaagacaggtcattgaagccggcgcgcttgacggtgtatcggcgatattcggcatgcataacaaacctgacctccccgtcggcacggtcggtctgaaagaaggcccgcttatggcgagtgtcgaccgctttgaaatcaccgtgaaaggaaaaggcggccacgccggaatccccgacaacagcattgacccgattcaggcgacagggcagatcatcggcggcctgcaatcgattgtcagcagaaacatcagctcgcttcacaatgccgtcgtcagcatcacaagagttcaggggggcagttcttggaatgtcattccggaccatgttgaaatggaaggaaccgtccggacgtttcaaaaagaagcgcgggacgctgttccgaaacatatgaagcgggttgccgaaggaatcgcggccggattcggggcagaggctgacttccgctggtttccttacctgccgtcagtgatgaacgatgcccgattcatacaggcggcggaacaaacggctgaaagcctcggacttcaaaccgttcgggcagaacagtcgcccggcggcgaagacttcgcattatatcaagaaaaaatccccggcttcttcgtctggatgggaacaaacggaacagaagaatggcaccatccagcctttacactcgacgaaaaagcgcttccgaaagcggctgagtttttcgcccggcttgccgtcaatgtattggagcagacggaatga

SEQ ID NO: 158 - protein, 383 aa, Bacillus amyloliquefaciens
MANETYESLNKRLINIRRDLHEHPELSGEEFETTNKIRRWLEEEGITVLDVPKLQTGVIAEIKGDKSGPVIAVRADIDALPIEEKTNLPFASRNSGVMHACGHDFHTASILGTAFLLNERKHELKGTVRFIFQPAEEIAAGARQVIEAGALDGVSAIFGMHNKPDLPVGTVGLKEGPLMASVDRFEITVKGKGGHAGIPDNSIDPIQATGQIIGGLQSIVSRNISSLHNAVVSITRVQGGSSWNVIPDHVEMEGTVRTFQKEARDAVPKHMKRVAEGIAAGFGAEADFRWFPYLPSVMNDARFIQAAEQTAESLGLQTVRAEQSPGGEDFALYQEKIPGFFVWMGTNGTEEWHHPAFTLDEKALPKAAEFFARLAVNVLEQTE

SEQ ID NO: 159 - DNA, 444 bp, Bacillus amyloliquefaciens
gtgacatggattgcagttgtttcaattgttgtcataagcctgattaagattgtgctgacatgccttcctaccggagcggtggaatggatcctccgcaagtttgaaacccattcaaagctcagtgacgagtccgctgccgtttccctcgggggaaaacgtctggaaggcgaagacaaacgacgggtgattgatgattttaacgaagccgtgtttatcgaacggcattatatatacccaggggatgaagagcgttatcttcatccgcaaaacggagccgatccgcttgtcattaagacgagaaaaggaaaaaaagatgtgacggtgtttgtatacagctacgaagatcatgtagatgtcgtcaagcagcagaaaaagaaagtaatcgcttattcagttctttccgacagcctgcaaaagcgcactatggccgccgccgggagctga

SEQ ID NO: 160 - protein, 147 aa, Bacillus amyloliquefaciens
MTWIAVVSIVVISLIKIVLTCLPTGAVEWILRKFETHSKLSDESAAVSLGGKRLEGEDKRRVIDDFNEAVFIERHYIYPGDEERYLHPQNGADPLVIKTRKGKKDVTVFVYSYEDHVDVVKQQKKKVIAYSVLSDSLQKRTMAAAGS

SEQ ID NO: 161 - DNA, 414 bp, Bacillus amyloliquefaciens
atgatgacgtcggatcatgattcgggagaatatgaacggctcatgaaaatgattgaatccattacgctgacgctctatgatatgaaaaaaattgtgatagccgccatccacggagccgcggcggggctcgggctgagtttcgcgctgtgcgccgatgtggtgctcgccgaagaaaacgcccgactcgcgatgaatttcatcggcatcggattggttcccgacggaggaggccattatttattaatgagacgcgtcggtgagatcgaagcgaaaaaactgatttggagcggtgaaaaattgccggctgaaaaagcggtgcggctcaagcttgccgacgggctgttcagcggcggccctgcggaggggcacaaccgtatatcgaccgattgctgcatgcgccgctgtcagcgatga

SEQ ID NO: 162 - protein, 137 aa, Bacillus amyloliquefaciens
MMTSDHDSGEYERLMKMIESITLTLYDMKKIVIAAIHGAAAGLGLSFALCADVVLAEENARLAMNFIGIGLVPDGGGHYLLMRRVGEIEAKKLIWSGEKLPAEKAVRLKLADGLFSGGPAEGHNRISTDCCMRRCQR

SEQ ID NO: 163 - DNA, 591 bp, Bacillus amyloliquefaciens
atggcgggagaaggaaagcctttgccgattgaattttaccagagaccgtcagtggagcttgcccctttattgctcggctgtctccttgtgaaggagacggatgagggaacggcttcaggttatatcgtggaaacggaagcttatatgggagcggatgaccgggcggcgcacagtttcggcaaccggcgcacgaaacggacggaaattatgttccatgaggcgggccgcatttatacatacgtcatgcacactcatacattaatgaacgtcgtcgcctcggacatcggcattccgcaggccgtgttaatcagggcggcggagcctcatgaaggacagttcctgatggagagcaggagaccgggcagacccccgagagagtggacaaacggcccgggaaaactgacgaaggcgatgggcatttcaatgaacgactacggcggcatgatcacggaaccgccgctgtatattacggagggctttacgcctgaacatatatcaacaggcccgagaatcgggattgacaacagcggagaagcccgggattatccgtggcgctattgggtgacggggaaccggtatgtctcacgctga

SEQ ID NO: 164 - protein, 196 aa, Bacillus amyloliquefaciens
MAGEGKPLPIEFYQRPSVELAPLLLGCLLVKETDEGTASGYIVETEAYMGADDRAAHSFGNRRTKRTEIMFHEAGRIYTYVMHTHTLMNVVASDIGIPQAVLIRAAEPHEGQFLMESRRPGRPPREWTNGPGKLTKAMGISMNDYGGMITEPPLYITEGFTPEHISTGPRIGIDNSGEARDYPWRYWVTGNRYVSR

SEQ ID NO: 165 - DNA, 294 bp, Bacillus amyloliquefaciens
atgaatgaagaatacacatatgcagcagatagtgatatgagaccgtttggacggcccggatttgggtttggacggccgggcttcgggttcgggcggcccggattcggcttcggcttcgggcggccgggttttggatttggccggccttggtttggttatggattcggacggccgtttggtttttacggcggaccgttcttcggagggcttgtcggggggcttgtcggaagcgctttattcaatccgtacctgtacggaggttacggctacccttactatccgtattactactaa

SEQ ID NO: 166 - protein, 97 aa, Bacillus amyloliquefaciens
MNEEYTYAADSDMRPFGRPGFGFGRPGFGFGRPGFGFGFGRPGFGFGRPWFGYGFGRPFGFYGGPFFGGLVGGLVGSALFNPYLYGGYGYPYYPYYY

SEQ ID NO: 167 - DNA, 966 bp, Bacillus amyloliquefaciens
atgaacgataacttcaagaaaaccaatcgtatttcaatgcttcagcaattgcagattaatggcagtgaacaaaccattatgattaatggtgatgacaggagtagtccgctgcttttgtttttgcatggcggtcccggcacgcctcaaatcggttatgcgagaaaataccagaatgagctggaaaagcatttcaccgttgtgaactgggatcagagaggggcgggtctctcttattcaaaggaaattccgggttcatctatgactttggatcagctgacagctgacaccattcatctgaccgaacgcttatgcaagcaattcagcaggagaaaaatatatatcgccggctattcgtggggttcagttttggcgcttcaagttcttcaagagaaacctgatttgtattatgcgtatatcggtatcagtcaggtggttaatattcaaaaggaagaaacggaagcctaccggttgatgatggaatggagcaggcaacacaaacatatcctgctgggcaagacgctgagctttatcggagcacccccatgggagaaacagctgcagcgaacgctgtttctgctttgtattgaaatgaggggagggggctttacccatcatccgatcggcgctcttaaagcaggggggcgaatgctgtttggtgaaccgtacggtgtgagagggagcttcttagccgcgcggggacaaatgttcagcctgaaacacctgtgggaggatctcatttcctttgatgcaggggaatcagtttcttctattgtaataccgtgctgttttatgtcagggagatacgatttgacggttccggggacgacgtcttatgaatattatcagaaggttgatgcgccgtataaagaatggcattggtttgagaactcagcccattcgcctcacttggaggaaccggatcgctttgccgaagttgtcagccggttcgcatcgttccatctctga

SEQ ID NO: 168 - protein, 321 aa, Bacillus amyloliquefaciens
MNDNFKKTNRISMLQQLQINGSEQTIMINGDDRSSPLLLFLHGGPGTPQIGYARKYQNELEKHFTVVNWDQRGAGLSYSKEIPGSSMTLDQLTADTIHLTERLCKQFSRRKIYIAGYSWGSVLALQVLQEKPDLYYAYIGISQVVNIQKEETEAYRLMMEWSRQHKHILLGKTLSFIGAPPWEKQLQRTLFLLCIEMRGGGFTHHPIGALKAGGRMLFGEPYGVRGSFLAARGQMFSLKHLWEDLISFDAGESVSSIVIPCCFMSGRYDLTVPGTTSYEYYQKVDAPYKEWHWFENSAHSPHLEEPDRFAEVVSRFASFHL

SEQ ID NO: 169 - DNA, 756 bp, Bacillus amyloliquefaciens
gtggctgaaagcttgttaatcagcggtgcggacatcgtaacagaaaaagaaatcatccgaaacggttttctcggtataaaggacggcatcatttcttacgcgggaaaaacaaggccgcaagaaacgtatgagaaggaatggaaggcgcccgagggctcgtatgcgcttcccggaatgattgatatccatattcacggcggatacggcgcggatacgatggatgccgatgttgcggctcttgatacactgtccgcccggctgcccgaagaaggaacaaccgcttttttagcgacaacgatcacacagcagcacgaaaacattgaaaaagcgctcatcaacgccaaaaaatgggcgtattcctcaccggagacccaaaaaggcgctgagttgatcggcattcatttagaaggaccgtttgtctctccgaaaaaggcgggagcacagccgaaacaatggattactcctgctgatgccgggctctttcagaaatgggagcggctctcgggagggctgatcaaaatcgtgacgcttgcgccggaagaagatcctgatttcagcctgatccgttatttaaaaaaccaaaacatcatcccctcaatgggacacacagacgcaggagccgagcttttacaaaaagcggcggatgccggggcggtgcatatgacgcacctctttaacgccatgagctcctttcatcaccgtgagccgggggcatcggtacggctctcgcctgcggccgcatcacggcggagctga

SEQ ID NO: 170 - protein, 251 aa, Bacillus amyloliquefaciens
MAESLLISGADIVTEKEIIRNGFLGIKDGIISYAGKTRPQETYEKEWKAPEGSYALPGMIDIHIHGGYGADTMDADVAALDTLSARLPEEGTTAFLATTITQQHENIEKALINAKKWAYSSPETQKGAELIGIHLEGPFVSPKKAGAQPKQWITPADAGLFQKWERLSGGLIKIVTLAPEEDPDFSLIRYLKNQNIIPSMGHTDAGAELLQKAADAGAVHMTHLFNAMSSFHHREPGASVRLSPAAASRRS

SEQ ID NO: 171 - DNA, 219 bp, Bacillus amyloliquefaciens
ttgctgcgcgccttaaaactgtcactcgcgatgctgattattatacttgcggccgccgcatttacgtatgcggaacatacctccgtcatacagccggttatgctcgtgtttctcggtgcggtcatgttcattcagggctggaggaaaaacggaaagaaaacgacggctccgggaaattcaatatctataccgccgtttttgtatggtcgatctccttaa

SEQ ID NO: 172 - protein, 72 aa, Bacillus amyloliquefaciens
MLRALKLSLAMLIIILAAAAFTYAEHTSVIQPVMLVFLGAVMFIQGWRKNGKKTTAPGNSISIPPFLYGRSP

SEQ ID NO: 173 - DNA, 606 bp, Bacillus amyloliquefaciens
ttgtctaaaacatatcaaaagtggatcgtattgggattattttttatcgtactgtgcacaggccgctcggcttttgcggcgacatctcagactcagacgggaggcctcgggaatatcggttttttccacgattacctgatcgagccgttttcggcacttttaaaaggggtggcgggcctgttccacggtgagtacggactgtcgattattctggtgacgattatcgtccggatcgttgtattgcctttgtttgtgaaccaatttaagaaacagcgggtgttccaggaaaaaatggctgtgatcaaaccgcaggtcgacagcattcaggctaaaatgaaacaaacgaaagatgcggaaaaacaaaaagaactgcaaatggaaatgatgaagctttaccgtgagcacaatctgaatccgatggcaatgggatgtcttccgatgctggtgcaattcccgattttgatcggtttttattacgccatccgctcaacgccggaaattgcttcacactcatttctgtggttcagcttagggcattctgatattcttgtatcactgtgcgcggggccatgtatttcttacaggcttatatttcccaaaaattaa

SEQ ID NO: 174 - protein, 201 aa, Bacillus amyloliquefaciens
MSKTYQKWIVLGLFFIVLCTGRSAFAATSQTQTGGLGNIGFFHDYLIEPFSALLKGVAGLFHGEYGLSIILVTIIVRIVVLPLFVNQFKKQRVFQEKMAVIKPQVDSIQAKMKQTKDAEKQKELQMEMMKLYREHNLNPMAMGCLPMLVQFPILIGFYYAIRSTPEIASHSFLWFSLGHSDILVSLCAGPCISYRLIFPKN

SEQ ID NO: 175 - DNA, 1509 bp, Bacillus amyloliquefaciens
atgtcagatcaatttacgagccgtgaagaacgccgtaaggcaaggcagacgaaaagcactaagccctcttcaccgaaaaaaggcaagaaacagcgtaaaggcggtttattcaaaaagattgtgctgtccttggttattctgtttgtccttggcatagtcggcggagcggcggcatttgccgttttggtttccggcgcgccgtctttggacgaagccaagctgaaaacgccttactcttcaacgatttacgataaaaacggaaaagaaatcgcggaagtgggcggtgaaaaacgaacctacgtcccgattaaggatatacccgatgttgtgaaagaagcatttatcgcaactgaagacgcccgtttttataagcaccacggtatagacccgattcgtatcggaggcgctttggtcgccaactttacggatgggttcggttcagagggaggaagcacaatcacccagcaggttgtgaaaaactcgcttttgacccatcagaaaacgattaaacggaaagcacaggaagtgtggctttccctgcagctggagcgccattattctaaagatgaaatcttagaaatgtatttaaacagaatttatttctcaccgcgcgcctacggcgtcggaaaagcggctgaagaattcttcggcgtaaaagacttgagcaagcttacggttgaacaggcggcaacgcttgccggaatgccgcaaagcccgaccggatataacccggttaaaaacccgaaggcttccgaaaaacgacgaaacatcgttctcagcttaatggaaaaacaaggattcatttcaaactctgaataccaaaaagcgaagaaagtgtccatgaaagatgaaggcgtcgtcagccaaaaggaatacgataaaaaggacacaaataaatacagcgcttttgtcgaagaagttatgaaagaaattgagacaaaagaaaagaaagacgtcgatatttcaactgacggactgaaaatttacacgactcttgatacgaaagcacaagattatcttgatcaattgatgaacggcgatacagccggatttaccgaaggcatgcagggcggcgtcacgctccttgatacgacaaacggagaaatccgcgccatcggggcaggacggaacagaactaccgggggattcaattatgcaacacaaggtaaaacccagcccggttcgacgataaaaccgattcttgattacggaccggtcattgaaaataaaaaatggtcgacgtatgaacagattgacgactcagcttatacgtactctgacggcacaccgattcatgattgggacaataaatacagaggccagatatcaatgcgagaggccctcgcagactcacgtaatattcctgctttaaaagcataccaagcagcaggaaaagatcatgccgtcgacttcgcaaacgacttaggattgggattaaacaaagatcaagtatatgaaccctactctatcggggatttggtgagggtaaccgcggtgtatctactatga

SEQ ID NO: 176 - protein, 502 aa, Bacillus amyloliquefaciens
MSDQFTSREERRKARQTKSTKPSSPKKGKKQRKGGLFKKIVLSLVILFVLGIVGGAAAFAVLVSGAPSLDEAKLKTPYSSTIYDKNGKEIAEVGGEKRTYVPIKDIPDVVKEAFIATEDARFYKHHGIDPIRIGGALVANFTDGFGSEGGSTITQQVVKNSLLTHQKTIKRKAQEVWLSLQLERHYSKDEILEMYLNRIYFSPRAYGVGKAAEEFFGVKDLSKLTVEQAATLAGMPQSPTGYNPVKNPKASEKRRNIVLSLMEKQGFISNSEYQKAKKVSMKDEGVVSQKEYDKKDTNKYSAFVEEVMKEIETKEKKDVDISTDGLKIYTTLDTKAQDYLDQLMNGDTAGFTEGMQGGVTLLDTTNGEIRAIGAGRNRTTGGFNYATQGKTQPGSTIKPILDYGPVIENKKWSTYEQIDDSAYTYSDGTPIHDWDNKYRGQISMREALADSRNIPALKAYQAAGKDHAVDFANDLGLGLNKDQVYEPYSIGDLVRVTAVYLL

SEQ ID NO: 177 - DNA, 1434 bp, Bacillus amyloliquefaciens
atgagtggcgataaaaaacatctggtcatcatcggcggcggcataacgggactagccgccgccttctacatggaaaaagaaatcaaggaaaaacagctgccgcttgaggtcaccctgatcgaagcgggcccgagagcgggcggcaaaattcagacggcgcataaagacggctacatcattgagcgggggccggattcttttttagaaaggaaaaaaagcgcgccgcagctcgttaaggatttggggcttgagcatctgctcgtcaacaatgcgaccggccagtcttacgtgctcgtcaatgagacgcttcatccgatgccgaagggcgcggtgatgggcattccgaccaaaatcgctccgttcatctccaccggtttattttctgtacccggaaaagcgcgggcggcgcttgactttgtcctgcctgcgagcaaaccgaaggaagatcagtctctgggtgaatttttccgcagacgcgtcggtgacgaagtcgttgagaatttaatagaaccgctattatcagggatttatgccggagatattgataagctgagcctcatgtccacgtttccgcaattctatcagactgagcaaaagcacagaagcctgattctcggtatgaaaaaatcacgtccgcagccttcgggacagcagctgacggccaaaaagcagggccagtttttaacggtgacgacaggacttcaaacgttggtggaggagctggaaaagcagcttacgctgacaaaggtgatgaaaggaacgaaagtcacccatatcggccgcgaggagaaaggatattccgtgacgcttgataatggcaaagtgctctatgcggaaggatgcatagtgacagccccgcataaagccgcggcgaaaatgctttctgatctgccggcggtttcatgtctcaaagatatgcattctacgtccgttgccaacgtcgccttaggttttcctgagggagccgtcaaaatggagcatgaaggtacgggattcgttatctcaagaaacagcgatttctccatcacggcctgcacatggacgaataaaaaatggccgcacgcggcgccggagggcaaaacacttctcagggcgtacgtcggaaaggccggagatgaatccatcgtagatctttcagataacgagatcattaaaatcgtaatggaagatttgaaaaaagtaatgaaaataaatggcgaaccggaaatgacctgtgtgacccgctggaacgaaagcatgccgcaataccatgtcggccataaggagcgcatcaaagagttcagagatgcgctgaaagcttcctatccgggcgtatacgcgacgggcgcgtctttcgaaggggtgggcatccccgactgtatcgaccagggaaaagccgccgtatatgattcactcgcttatttatttgaaacgtaccagcctccgttatcgtaa

SEQ ID NO: 178 - protein, 477 aa, Bacillus amyloliquefaciens
MSGDKKHLVIIGGGITGLAAAFYMEKEIKEKQLPLEVTLIEAGPRAGGKIQTAHKDGYIIERGPDSFLERKKSAPQLVKDLGLEHLLVNNATGQSYVLVNETLHPMPKGAVMGIPTKIAPFISTGLFSVPGKARAALDFVLPASKPKEDQSLGEFFRRRVGDEVVENLIEPLLSGIYAGDIDKLSLMSTFPQFYQTEQKHRSLILGMKKSRPQPSGQQLTAKKQGQFLTVTTGLQTLVEELEKQLTLTKVMKGTKVTHIGREEKGYSVTLDNGKVLYAEGCIVTAPHKAAAKMLSDLPAVSCLKDMHSTSVANVALGFPEGAVKMEHEGTGFVISRNSDFSITACTWTNKKWPHAAPEGKTLLRAYVGKAGDESIVDLSDNEIIKIVMEDLKKVMKINGEPEMTCVTRWNESMPQYHVGHKERIKEFRDALKASYPGVYATGASFEGVGIPDCIDQGKAAVYDSLAYLFETYQPPLS

SEQ ID NO: 179 - DNA, 1251 bp, Bacillus amyloliquefaciens
gtgctgactggatttacgccatggccggaagaatgggctgaaaaataccgaaaagacggctgctggaagggtgagacgttcggaggaatgctgaaagagcgcgcggctttatacggaaatcaaactgccgtgacgtgtaaagatgtacattggacctacaaagaattagatgaaagggccgatcgtttagcggcggggctgcataagctcggaattcaaaaggaagaccgcgttgtcgttcagctgccgaatatcgctgagttttttgaagtgattttcgcgctgttccgactcggagcactgcccgttttcgcgctgccttctcatagaagcagtgagattacgtatttctgcgagtttgcagaggcgaaagcatacatcattcctgatacgcattcaggttttgattacagggcgcttgccagacaggtgaaagacaaacttccggatttggcgcatgtcattgtggccggcgaagctgaagagtttcaggaactgagcagcctgcatagagagcctgttcagctggaagaggtaagcccggcggaagtcgcttttttacagctttcaggaggcagtacggggctgtccaagctgattccgcgaacacacgacgattacatatacagtttgcgcctcagcgcggaaatatgcggcttggatcatcacagcgtttatttggccgctctgccgacagcgcataattatccgctcagctcgccgggtgtgctgggaactttatatgccggaggccgtgttgttctgtcaccgacgccgagtccggatgactgcttcccgttaattgaaaaagaacgtgtcacgattacagcgctcgtcccgccgcttgcgatggtgtggatggacgcatccggttcgcgaagtgatgatttatcaagccttcaagtgctgcaggtgggaggcgccaaattcagtgctgaggcggcccgccgcgtaaagagcgctttcggatgcacccttcagcaggttttcggaatggcggaaggattggtgaattatacgagactggatgatcctgaagagatcattgtcaatacgcaaggcagaccgatgtcaccttttgatgaggtaagggttttagacgatgacgggcgggatgtcgccccggagaagcgggacatttgtttacacgcggcccttacacgattcgcgggtattataaagcgcctgaacataatgaaagatcattcacagccgacggattttatcagaccggcgatatcgtcaaactga

SEQ ID NO: 180 - protein, 416 aa, Bacillus amyloliquefaciens
MLTGFTPWPEEWAEKYRKDGCWKGETFGGMLKERAALYGNQTAVTCKDVHWTYKELDERADRLAAGLHKLGIQKEDRVVVQLPNIAEFFEVIFALFRLGALPVFALPSHRSSEITYFCEFAEAKAYIIPDTHSGFDYRALARQVKDKLPDLAHVIVAGEAEEFQELSSLHREPVQLEEVSPAEVAFLQLSGGSTGLSKLIPRTHDDYIYSLRLSAEICGLDHHSVYLAALPTAHNYPLSSPGVLGTLYAGGRVVLSPTPSPDDCFPLIEKERVTITALVPPLAMVWMDASGSRSDDLSSLQVLQVGGAKFSAEAARRVKSAFGCTLQQVFGMAEGLVNYTRLDDPEEIIVNTQGRPMSPFDEVRVLDDDGRDVAPEKRDICLHAALTRFAGIIKRLNIMKDHSQPTDFIRPAISSN

SEQ ID NO: 181 - DNA, 1629 bp, Bacillus amyloliquefaciens
atgaaagaaatgttaaaaataagcggcatcagttacgaaatcaacagcgttcccctttttgaacagatcagcgcgagtgttcagcaaggcgacatcatcggtgttatcggtaaaaacggcgccggcaaatctttattgctgcaattgatctgcaataaaaaagcgccgtcacaaggacagatccagatgatgcaagatgtgaacatatatatggtggaacaagaaacggaagcttatgattccggccatccggagcctgcggaggcagccttgttagaaaagtggaacgtgcccgcacgcgccttttcgcaattaagcggcggagaaaaattgaaagcccgtcttgccaaaggtttctcctcctcaagcggccttttgttattagatgagccgacgaaccacctcgatcagcacagtttagaaatactgcttaatcagatcaagaattacaaaggcaccattattttcgtttcacatgatcgtgcttttatagatgcggcggcgacaaaaatctgggccatcgaaggaaagaaactcattgaacataaagggaattattcaagctatatggaggtccgcaaacagagaaggctgacacagcagcgggaatatgagaatcagcagcatatgatcagacggattgaagctcaaatgaacgagctgagcgcctggtcaaaaaaagcccacgcccaatcaacgaaaatagaaggctttaaagaatatcaccgcgtaaaagcaaaacgcacggacgcccagattaaatcaaagcagaagcgtcttgaaaaagagcttgaaaaagcgaaagcagaaccggttgaagcggagtatgaagtccgtttttccattgagcaccgcaaaaaagcgggaaagcgttttttagaagtaagtgatgtcacaaagtcatatgaaggccgaacgctttttaaaaacgtgaatttcactgtgatgcacggtgaaaagatcgcgattacaggcccgaacggcagcgggaaaacaacattattgaaggtcatcctcggtcaggaaaaagcgcagggcggcatatggatttctccgtctgcaaacgtcggctatttaacccaggaagtattcgaccttccgcttgataaaacccccgaacagcttttttacaaagaaacgttcgaagcaaggggaaatgttcaatccctcatgaagcatttaggatttaccgcagcgcaatggacggaacccatcggcaagatgagcatgggagagcgggtcaaatgcaagctgatggcgtttattctgggggagaaagatgtgctgattctggatgagccgacaaaccaccttgatctgccgtcacgcgagcagcttgaagacactttggcccgatacgacggaacgctcatcatcgtatcgcatgatcgttactttgtcgaaaagacgacggacatccggcttgatatctcaaacggcagcgtccgaaaacaatggaaagaatctccctccgtcagggatgatgctgaagaactgcgattaaagtttgaaaccgaacggcaggaagtcctcggaaaactcagcttcatgactccggctgataaacaatatcgtgagcttgatcaaaagttcaaagagctgacggaagaaatcaagaagttgaaatga

SEQ ID NO: 182 - protein, 542 aa, Bacillus amyloliquefaciens
MKEMLKISGISYEINSVPLFEQISASVQQGDIIGVIGKNGAGKSLLLQLICNKKAPSQGQIQMMQDVNIYMVEQETEAYDSGHPEPAEAALLEKWNVPARAFSQLSGGEKLKARLAKGFSSSSGLLLLDEPTNHLDQHSLEILLNQIKNYKGTIIFVSHDRAFIDAAATKIWAIEGKKLIEHKGNYSSYMEVRKQRRLTQQREYENQQHMIRRIEAQMNELSAWSKKAHAQSTKIEGFKEYHRVKAKRTDAQIKSKQKRLEKELEKAKAEPVEAEYEVRFSIEHRKKAGKRFLEVSDVTKSYEGRTLFKNVNFTVMHGEKIAITGPNGSGKTTLLKVILGQEKAQGGIWISPSANVGYLTQEVFDLPLDKTPEQLFYKETFEARGNVQSLMKHLGFTAAQWTEPIGKMSMGERVKCKLMAFILGEKDVLILDEPTNHLDLPSREQLEDTLARYDGTLIIVSHDRYFVEKTTDIRLDISNGSVRKQWKESPSVRDDAEELRLKFETERQEVLGKLSFMTPADKQYRELDQKFKELTEEIKKLK

SEQ ID NO: 183 - DNA, 1920 bp, Bacillus amyloliquefaciens
atgaatcgggtcttccgtaataccattttttatttacttattttattagtagtaatcggggttgtgagttacttccagacctcaaacccgaaaacagaaaatatgtcgtacagtacgtttatcaagaacctcgatgaagggaaagttgatagcgtatcggttcagcctgtcagaggtgtttatgaggtaaaaggacagctgaaaaaatacgacaaagaccagtactttttaacacatgttcctgaaggaaaaggagcagaccagatatttgacgcaattaaaaagacggacgtaaaagttgatcccgcacaggaaacaagcgggtgggtgacgttcttaacgacgatcattccgtttgtcatcatctttattctgtttttcttcctgctcaatcaggctcagggcggcggcagccgtgtcatgaacttcggaaagagcaaagcgaagctgtatacggaagaaaagaaacgcgtgaagtttaaagatgtagccggcgcggatgaggagaagcaggagctcgttgaggttgttgagtttctgaaagatccccgcaaattcgccgagcttggcgccaggatccctaaaggcgtgctgcttgtcggacctccgggaaccggtaagacattgcttgcgagagcctcagccggtgaagctggcgttcctttcttcagcatcagcggatctgacttcgttgaaatgtttgtcggtgtcggtgcttcccgtgtgcgtgatttattcgaaaatgcgaaaaagaatgcgccttgcctgatcttcattgatgagatcgacgcggtaggacgtcagcgcggcgccggtcttggcggcgggcatgatgaacgcgaacagacgctgaaccagctgcttgttgagatggacggtttcagtgcgaatgaaggaatcattattatcgctgcgacaaaccgtgcggacattcttgaccctgcattgctccgtccgggacgttttgaccgtcagattacggtagaccgtccggatgtcatcggccgtgaagccgtattgcaggtgcatgcgagaaacaaaccgcttgatgagacggtgaacttaaaagcaatcgcttcaagaacacccggtttctcaggcgcagatttagaaaaccttcttaacgaagcggcactcgttgctgcccgtcaaaacaagaagaaaattgatatgcgcgacattgatgaagcaacggaccgtgtcattgcgggtcctgcgaagaagagccgcgtcatctcgaaaaaagaacgcaatatcgtggcgtaccacgagggcggtcacaccgttatcggacttgtgctggatgaagccgatatggttcataaagtaacgattgttccgagggggcaggcaggcggatacgcagtcatgcttccgagagaagaccgttacttccagacaaaacctgaacttctcgataaaattgtcggtcttctgggcggacgtgttgccgaggaaattatcttcggcgaagtcagcacgggggctcacaatgacttccagcgggcaacgaacattgccagaagaatggtgacagagttcggtatgtcagaaaaactcggaccgcttcagttcggtcaatctcaaggcggtcaagtattcctgggccgggatttcaacaacgagcaaaactacagtgatcagatcgcttacgaaattgatcaggaaattcagcgcatcattaaagaatgttatgagcgtgcgaaaaccatcctgactgaaaatcgcgataagcttgaattgattgctcagacattgcttgatgtggaaacattagatgcggaacaaatcaagcatctcgtggatcacggaaaactccctgagcgcaatttctcagatgaccatcttcaaaaagacgatgtgaaagtaaacatcctgtctaaaacagaagacgaaaagaaagacgagccgaaagaatag

SEQ ID NO: 184 - protein, 639 aa, Bacillus amyloliquefaciens
MNRVFRNTIFYLLILLVVIGVVSYFQTSNPKTENMSYSTFIKNLDEGKVDSVSVQPVRGVYEVKGQLKKYDKDQYFLTHVPEGKGADQIFDAIKKTDVKVDPAQETSGWVTFLTTIIPFVIIFILFFFLLNQAQGGGSRVMNFGKSKAKLYTEEKKRVKFKDVAGADEEKQELVEVVEFLKDPRKFAELGARIPKGVLLVGPPGTGKTLLARASAGEAGVPFFSISGSDFVEMFVGVGASRVRDLFENAKKNAPCLIFIDEIDAVGRQRGAGLGGGHDEREQTLNQLLVEMDGFSANEGIIIIAATNRADILDPALLRPGRFDRQITVDRPDVIGREAVLQVHARNKPLDETVNLKAIASRTPGFSGADLENLLNEAALVAARQNKKKIDMRDIDEATDRVIAGPAKKSRVISKKERNIVAYHEGGHTVIGLVLDEADMVHKVTIVPRGQAGGYAVMLPREDRYFQTKPELLDKIVGLLGGRVAEEIIFGEVSTGAHNDFQRATNIARRMVTEFGMSEKLGPLQFGQSQGGQVFLGRDFNNEQNYSDQIAYEIDQEIQRIIKECYERAKTILTENRDKLELIAQTLLDVETLDAEQIKHLVDHGKLPERNFSDDHLQKDDVKVNILSKTEDEKKDEPKE

SEQ ID NO: 185 - DNA, 666 bp, Bacillus amyloliquefaciens
atgggcatagcaggaacgtttctatttatgatcgtgatcggagccgcgatcggcgcggtgacgaatcatcttgccattcagatgttatttcgtccgtaccggccgtattacctgttcggaaaacgggttccgtttacgccggggctgatcccgaaaagacgggatgaattggcaaaacaaatggggctcatggtgacgaaccaccttttaaccccggaaggaataaaaaagcggcttttatcagataacgttaaaaaccaggcgcttcttttcgccgaacaattcacgcaaaaaatggccgcttccgaaatgacggtgcacgaagctttggccgccgcgggcatccggaatccgcaggaaaagacggatgcctggattgaccgttttaccgatgaaaagctttcggacctgtaccggaaatatgagcaccgcgccatcaaagactggcttcctgatgagctgcaggaaaagctggatgaaaaaatcccgctggccgcagattatatcctgaagcgtagcattgattattttgagagcgaagaagggaaagacagactcggaaatatgattgacgactttttgaattcccggggatgctcggcggcatggtgcagatgttcctcggcaattcaagcttggcagaccgtgtgctgcctgagctgttaa

SEQ ID NO: 186 - protein, 221 aa, Bacillus amyloliquefaciens
MGIAGTFLFMIVIGAAIGAVTNHLAIQMLFRPYRPYYLFGKRVPFTPGLIPKRRDELAKQMGLMVTNHLLTPEGIKKRLLSDNVKNQALLFAEQFTQKMAASEMTVHEALAAAGIRNPQEKTDAWIDRFTDEKLSDLYRKYEHRAIKDWLPDELQEKLDEKIPLAADYILKRSIDYFESEEGKDRLGNMIDDFLNSRGCSAAWCRCSSAIQAWQTVCCLSC

SEQ ID NO: 187 - DNA, 1329 bp, Bacillus amyloliquefaciens
ttgaaaaaactcataaccgaggaggacattgcgtcactcgtatccgtgacagacccgcaatatgcccctgacggcagaagagccgcttacgtccggacaacagtcaatcataagcgtgattcctattcctcagccattatggtatatgacacagaatccggcatctcaaacccgtggactttcggggacgataaaaatacaagtccgcggtggtcgcctgacggtcggcgcctcgcctttgtttctgacagggaggacggcatccctcagctgtacatcatcgacgctgccggcggagaggcggaacaggctgccgatattccttggggcgtatcagatccgatatgggcgcccgacggcagatccgtgcttgtgtccgtcagtctgacatcagcggagcgcgccgatgagaaagaaaaaaagaagcatgacgagtatgagccggttgagattcaatcattaacatataaacgtgacgggaagggcctgctgaacggaagccggacacagcttgtgctgattcatcttgaaacgggggagattcagcagctgacagatcatgaagctgatcattatggcgcggccttttcaccggatggcaggcagcttgcgtttaccgccaatttatgcgagccgggtgacgccggaaagccgagcgatgtctatctgatgaatctggcggacggaagcctgaagcagattacgccgcaccgcggttctttcggttcctgcgtgttttcaccggacggttcttatatcgcgatgctgggccatgagaatgaatttcgcaatgcgactttagagaaagcgtggctgtacgacgtgaaaactgagcggctgtcctgcctgaccgacatgctggatgttcatttgagcgatgcgctgattgcggattcaatcataggaggagtgacgccccggccggtatggacaaacgacgggcagggcttttacgttctcgggagcgagcagggaagcaccggtatttattatatctcgattgacggcctcgtatatccgatccgattagaagaagagtacgtgaacggttttgcttttcatcctgatcagaaaagctgtatcgctgtcattgccaaacccgcacagccttccgagctttacagcatttcacttgaaaatggggaagagaggcaattgacattttacaatgatcggtttatagaggagcgtatcatatccgtgccggaaaagctgcaatatgaaacaaaggacgggctgacggtaaacggctggtttttaaagccttccgtttttgaagaggatcaaacatatccctcattctatacatacacggcgggcctcacatga

SEQ ID NO: 188 - protein, 442 aa, Bacillus amyloliquefaciens
MKKLITEEDIASLVSVTDPQYAPDGRRAAYVRTTVNHKRDSYSSAIMVYDTESGISNPWTFGDDKNTSPRWSPDGRRLAFVSDREDGIPQLYIIDAAGGEAEQAADIPWGVSDPIWAPDGRSVLVSVSLTSAERADEKEKKKHDEYEPVEIQSLTYKRDGKGLLNGSRTQLVLIHLETGEIQQLTDHEADHYGAAFSPDGRQLAFTANLCEPGDAGKPSDVYLMNLADGSLKQITPHRGSFGSCVFSPDGSYIAMLGHENEFRNATLEKAWLYDVKTERLSCLTDMLDVHLSDALIADSIIGGVTPRPVWTNDGQGFYVLGSEQGSTGIYYISIDGLVYPIRLEEEYVNGFAFHPDQKSCIAVIAKPAQPSELYSISLENGEERQLTFYNDRFIEERIISVPEKLQYETKDGLTVNGWFLKPSVFEEDQTYPSFYTYTAGLT

SEQ ID NO: 189 - DNA, 621 bp, Bacillus amyloliquefaciens
atgaaaacagcaggcatttacctggcagccggtacaagcagacgcatgggaacggataagcgaagtttatttctcaatggcgtttccctcggaagtatggctcttaaaaatgccttgttatctgaattagatcatatttttgttattacgagaaagggagattcactgcattggctttcggattttttctttttagatcccatgtcaaataagtggagccaggcagaatgtgagcaagcgggtaagggccaaggccattctatacaatgcggtttgcaaaaagcggcagcgtacgaggctgacgccgttatcattctccttgcagatcagccgtttgtcaccgcagatatcatcaatacgttaattgattcctatcaaaaagagcgccgttattcatttatcgccgctgaaaatcagcatcttcctatgccccccattttattctcaaatcaatgtttcccggtattgcatcagttaaagggagatcagggcgcccggcatgtgatccgtgaaagtatgatcaatatgggaaaaatgatcagctttcaagaccctttgcttttttatgacgtcgatacagttgaagattatacgctgctgctgaataaattcggggagtga

SEQ ID NO: 190 - protein, 206 aa, Bacillus amyloliquefaciens
MKTAGIYLAAGTSRRMGTDKRSLFLNGVSLGSMALKNALLSELDHIFVITRKGDSLHWLSDFFFLDPMSNKWSQAECEQAGKGQGHSIQCGLQKAAAYEADAVIILLADQPFVTADIINTLIDSYQKERRYSFIAAENQHLPMPPILFSNQCFPVLHQLKGDQGARHVIRESMINMGKMISFQDPLLFYDVDTVEDYTLLLNKFGE

SEQ ID NO: 191 - DNA, 630 bp, Bacillus amyloliquefaciens
ttgctgaaaataggttcacacgtctcaatgagcggaaaacatatgctccttgccgcaagcaaggaagctgtttcgtacggggcgaatacatttatgatctatacgggcgctccccaaaacacgcgccgcaaaaaaattgaagacttgaatatcgaagcgggccgcgcccatatgaaggaaaacggcatcgatgagattgtcgtgcatgcgccgtacatcattaacatcggaaatactacaaatccggcaacgtttgagctgggtgttgattttctgcgttctgaaattgaaagaacggcagcaatcggcgcgaaacagatcgtgcttcatccgggagcgcatgtcggagccggggctgagacgggcatcaaaaaaatcattgaaggtttaaacgaagtgattgttcccggtcaaaacgtgcagattgcgctggaaacaatggcgggcaaaggatcagaatgcggaagaagctttgaagagctggccgagatcattgcggggttacgcataatgaacatctatccgtctgctttgacacttgccacacccatgacgccgggtatgatgtcgccaatgattttgacggtgttcttaacgagtttgataaaatcgtcggcatcgatcggataa

SEQ ID NO: 192 - protein, 209 aa, Bacillus amyloliquefaciens
MLKIGSHVSMSGKHMLLAASKEAVSYGANTFMIYTGAPQNTRRKKIEDLNIEAGRAHMKENGIDEIVVHAPYIINIGNTTNPATFELGVDFLRSEIERTAAIGAKQIVLHPGAHVGAGAETGIKKIIEGLNEVIVPGQNVQIALETMAGKGSECGRSFEELAEIIAGLRIMNIYPSALTLATPMTPGMMSPMILTVFLTSLIKSSASIG

SEQ ID NO: 193 - DNA, 816 bp, Bacillus amyloliquefaciens
atgatcgggtttctcggttttctcattgaaatggcgtccgatgccgttgaaatgacggttcagttttccggcggcaagcagattatgatgccggacaagctggcggatattgcggttatcgctgtttctcacacatttattgtgctgagttttttcaacgtgatgaagctgcacgaatctcaggtcagggaaaaacaaacgagaaagcagcatgagcacatgctgatgattgtgtctaacttatatgaagaaacgattcatctgaaaaaaacgctgaaaacgacggagcatgtgacgaaagaatcctatcagctgtatcgggaaatgagcgggaacgaccgggagctcgggagccgaatgctgcgccttgcgggagaaattcatgaagtgaaaaaagacaatcagcgaatattcgccggcctgtcgaagctgatttcaaatgagagattccgggattacatgaatgccgccgatctggtcggcctcgttatccgcatcaatgaaaaatacgccgaatctttaggcaaagacattcaattcaaaaacgtgattgaaggagaacaccccgattatcacgtctttaccgtcctgtcgatcttaaataacctgaccgccaatgccgtcgaagccatgggtgacaggggtgagatccgcctcgcgctgcgcagggcggaggggggatggccgaatttgaggcggaagatgacggtcccggcattccggaaaaaatcggagaggtcgtttatgatcccggttttacgtccaaatacgatgaattcggcgcaccttcaacgggcatcgggctttcatacgtga

SEQ ID NO: 194 - protein, 271 aa, Bacillus amyloliquefaciens
MIGFLGFLIEMASDAVEMTVQFSGGKQIMMPDKLADIAVIAVSHTFIVLSFFNVMKLHESQVREKQTRKQHEHMLMIVSNLYEETIHLKKTLKTTEHVTKESYQLYREMSGNDRELGSRMLRLAGEIHEVKKDNQRIFAGLSKLISNERFRDYMNAADLVGLVIRINEKYAESLGKDIQFKNVIEGEHPDYHVFTVLSILNNLTANAVEAMGDRGEIRLALRRAEGGWPNLRRKMTVPAFRKKSERSFMIPVLRPNTMNSAHLQRASGFHT

SEQ ID NO: 195 - DNA, 1725 bp, Bacillus amyloliquefaciens
atgggcacaaatgtacaggcggattctttgtctgccgattgtacaaaaacaatgaacggggctctgatgctgattgaatcattaaagaaagaaaatgtcgagatgatcttcggctatccggggggagccgtccttccgatttacgataaactgtatcaatcaggattggttcacatcctgccccgccacgagcaaggcgcgattcatgcggcagaagggtatgcgagagtctccggaaagccgggggttgtgattgctacctccggacccggagcgacaaatttagttaccggtcttgcggatgcgatgattgattcactgccgctcgtagtgtttaccggtcaggtcgccacttcggtcatcggcagcgacgctttccaggaagccgacattttaggaattacgatgccgattacgaaacacagctaccaagtccgccgtccggaagatctcccccgtgtgattaaagaggcgttccatattgccacgacgggaagaccgggcccggtattaattgatataccgaaggatgtcgcagcatttgaaggagaattcagatatgatcacgagatcaatcttccgggttatcagccggtaaaagagcctaactatctgcagatccgaaagctcgtggaagctgtcagcagtgcgaaaaagccggttattttagccggagcgggtgttttgcacggtaaagcttcagaagatttaaaaaattatgccgaacagcagcaaattccggtagcgcacacgcttctcggtctgggcggtttcccggcagaccatcctctttttctgggaatggcggggatgcacggcacatacacagcgaatatggcgctttaccactgtgacttgctgatcagcatcggagcgcggttcgatgatcgcgtgaccggaaatctgaagcattttgcaaaatcggccaaagtagcgcatatcgatattgatcctgctgaaatcggaaaaattatcgaaacgcagattccggtggtcggcgacagtaaaatcgtccttcaggaattattgaagcaaaacggaaaacagggacagacagaggaatggaaacagcagctttcagaatggaaagaagaatatccgctttggtatacagacgacagagaagagggcttgaaaccccaaaagctgattgagtatattcaccaattcacaaacggtgaggcgattgtggcgacggatgtcggccagcaccagatgtgggcggctcagttttatcctttccgaaaggctgataagtgggtgacctcgggggggctcggcacaatgggcttcggccttccggcggccatcggagcgcagctggccgatcgtaacgccacggtcgttgccatcctcggagacggcggttttcagatgacccttcaggaattagatgtcatccggcagctgaatcttcctgtcaaagtggttatcttgaacaacgaatgtctgggcatggtcagacagtggcaggaaatcttctatgaagaacgctattctgaatccaaattctcggcgcagcctgactttgtcaaattgtcagaagcctacggcattaaaggcgttcggatttcatcggaagaagaggcggaagaagagcttaaaaaggcgctttcatcaaaagaaccggccgttattgacgtccgggtcgccaaaagcgagaaagtattcccgatgatcgcgccgggtaaaggacttcatgaaatggtgggggtgaaaccttga

SEQ ID NO: 196 - protein, 574 aa, Bacillus amyloliquefaciens
MGTNVQADSLSADCTKTMNGALMLIESLKKENVEMIFGYPGGAVLPIYDKLYQSGLVHILPRHEQGAIHAAEGYARVSGKPGVVIATSGPGATNLVTGLADAMIDSLPLVVFTGQVATSVIGSDAFQEADILGITMPITKHSYQVRRPEDLPRVIKEAFHIATTGRPGPVLIDIPKDVAAFEGEFRYDHEINLPGYQPVKEPNYLQIRKLVEAVSSAKKPVILAGAGVLHGKASEDLKNYAEQQQIPVAHTLLGLGGFPADHPLFLGMAGMHGTYTANMALYHCDLLISIGARFDDRVTGNLKHFAKSAKVAHIDIDPAEIGKIIETQIPVVGDSKIVLQELLKQNGKQGQTEEWKQQLSEWKEEYPLWYTDDREEGLKPQKLIEYIHQFTNGEAIVATDVGQHQMWAAQFYPFRKADKWVTSGGLGTMGFGLPAAIGAQLADRNATVVAILGDGGFQMTLQELDVIRQLNLPVKVVILNNECLGMVRQWQEIFYEERYSESKFSAQPDFVKLSEAYGIKGVRISSEEEAEEELKKALSSKEPAVIDVRVAKSEKVFPMIAPGKGLHEMVGVKP

SEQ ID NO: 197 - DNA, 438 bp, Bacillus amyloliquefaciens
atgaaaacaaaagaattagtcattatggccctgtttgcggcaatcggagcggtgcttcattccattatgccgccggtattattcggaatgaaacccgatatgatgcttgtgatgatgtttatgggtattctgttatttccccgtgtgcagaacgtgctgatgatcgggattgtaacgggaatcatttccgcactcacgacatcttttccgggcggacagcttccgaatatcattgaaaaaccggtaacggcgtttctgtttctcgcgctggcgcttttggtgaaaaagagcgtgaaaacagcggccgccgccgtcattacaatagccggcaccttcatctccggtttgctctttctggcgctggcccttctgattgtcggcctgccgggggattcaccgccttggtgctcgcggtcgtccttccggcggctgcgctga

SEQ ID NO: 198 - protein, 145 aa, Bacillus amyloliquefaciens
MKTKELVIMALFAAIGAVLHSIMPPVLFGMKPDMMLVMMFMGILLFPRVQNVLMIGIVTGIISALTTSFPGGQLPNIIEKPVTAFLFLALALLVKKSVKTAAAAVITIAGTFISGLLFLALALLIVGLPGDSPPWCSRSSFRRLR

SEQ ID NO: 199 - DNA, 924 bp, Bacillus amyloliquefaciens
atgaacgaaaaaaaagagaaaatcataaaaacaggcatccatttatttgccaaaaaagggttttcttcaacaaccattcaggaaatcgccggtgaatgcggaatttcaaaaggggccttctatcttcattttaaatcaaaagaagaccttttgctctcagcatgtgagtattacatcggcatgtctatggaagaaataaagaaaatcaaaacagaacatcagcataaatcgcctaaggacgtattccgaaaacaaatcgcttatcaattccaggaatttatggagcacaaggactttatcattctcttgctgagcgaaaaggtcattcctgaaaatcaaaaggtcaaacagtattttcatgaggccaatattcaatttaacatactgtaccgggatgctttgctctccgtttacagagatgccgtcataccgtttatagcggatgcgtccgttatggcgcaaggaatagtgagctcctatattcatttcttgatttttaatgaacatacggcattccggacggaaaacgtggcggcctttctgattgccagaatcgatgacctgattacgggactgataagagacaatcccgatccgctgctgccgcaggatatcttcactcagccggcggcggacagagaaagactgcttgcggatattcaaaagataaaagcacagcagggctgcctgaggacgtcctcgtatcgcttgaagtcattgaagaggaatacgcaaaggaagagccgcgaaaaccgattattaaaggaatgctgtccaacttggcaggcagcggaaatgagcagattgaaacgctgcgggcttccattgaaacctatttcagcttataaaaaaagagaccggcgcttaccggtctccgtgtcagcagcgcccttagaggcggctgctttttttatcgttttttga

SEQ ID NO: 200 - protein, 307 aa, Bacillus amyloliquefaciens
MNEKKEKIIKTGIHLFAKKGFSSTTIQEIAGECGISKGAFYLHFKSKEDLLLSACEYYIGMSMEEIKKIKTEHQHKSPKDVFRKQIAYQFQEFMEHKDFIILLLSEKVIPENQKVKQYFHEANIQFNILYRDALLSVYRDAVIPFIADASVMAQGIVSSYIHFLIFNEHTAFRTENVAAFLIARIDDLITGLIRDNPDPLLPQDIFTQPAADRERLLADIQKIKAQQGCLRTSSYRLKSLKRNTQRKSRENRLLKECCPTWQAAEMSRLKRCGLPLKPISAYKKRDRRLPVSVSAAPLEAAAFFIVF

SEQ ID NO: 201 - DNA, 525 bp, Bacillus amyloliquefaciens
atgacaccatttacgattacggaggagaaggcgggggcattccgggtcacctccgcccggaaggatgatgaagaagaagtcatggatctgctcgtgcaggcggcagaatggcttcgcgataaagggtcgaaccagtggagcggccttctgcaaggggaagatacccacaatatgcgggaggcgatcgccaaagggtatgtttttttattcaggcagaatgaagagctggccggcgtcgtcatgctgcttcccgaagcaagcgggtgggacagacgtctatggggcgatgaaggacatgaggagtccgtatatctccaccggctggcgattaacaggcggtttgcaggggcggggctcggccggacgatcatgacttgggcggagacggggtgtcttgtcctggaaaaacgaaaatccggctcgactgcgtgtccggaaacaaggcgcttcagtcgttttacagcggaatgggttacgaatcaaaaggactcgcgccgggttatcatttgtttgaaaaaaaggtga

SEQ ID NO: 202 - protein, 174 aa, Bacillus amyloliquefaciens
MTPFTITEEKAGAFRVTSARKDDEEEVMDLLVQAAEWLRDKGSNQWSGLLQGEDTHNMREAIAKGYVFLFRQNEELAGVVMLLPEASGWDRRLWGDEGHEESVYLHRLAINRRFAGAGLGRTIMTWAETGCLVLEKRKSGSTACPETRRFSRFTAEWVTNQKDSRRVIICLKKR

SEQ ID NO: 203 - DNA, 861 bp, Bacillus amyloliquefaciens
atgattgcccttcatttcggagcgggaaacatcgggcggggctttatcggcgccctgctccatcattccggctatgacgtagttttcgctgatgtgaatgaaacgatggtcagccttctcaatgaaaagaaggaatataccgtggagcttgccgacggcggcaggcagacagaaatcatcggccccgtttcagccatcaacagcgcggtgcaagaacaagagctgtacgggctgatcaatgaagcggcgatcattacgacggcggtgggcccgaacgttctcagactcatcgccccgtccatcgcggaaggtctgaagcgcagaacgtcctctgagcctctcaatatcattgcctgtgaaaatatgatcggcggcagcagttttctgaaaaaagaagttttcggacatttgacggaagcggagcgggaactcgtgaaccggacagtcggcttcccggattctgcggtagatcggatcgtgccgattcagcaccatgaagatccgctgaaagtatccgtagaaccgttttttgaatgggtcatagacagaaccggctttgccggcgatcagccggtacttaaaggcgcgttgtttacggatgatcttacgcctttcattgagagaaagctgtttaccgtcaataccgggcatgccgtcacggcgtatgtcggctatcagcgcggattaaaaaccgtcaaagaggccatcggccatccggaaatccggcgtgtcgtgtacgatgcactttcagaaacgggcgagtacttggtgaaagcgtacggctttaagcaagccgaacacgagcagtacatgaaaaaatcatcagccgctttgataatgaatacatcacggatgatgtga

SEQ ID NO: 204 - protein, 286 aa, Bacillus amyloliquefaciens
MIALHFGAGNIGRGFIGALLHHSGYDVVFADVNETMVSLLNEKKEYTVELADGGRQTEIIGPVSAINSAVQEQELYGLINEAAIITTAVGPNVLRLIAPSIAEGLKRRTSSEPLNIIACENMIGGSSFLKKEVFGHLTEAERELVNRTVGFPDSAVDRIVPIQHHEDPLKVSVEPFFEWVIDRTGFAGDQPVLKGALFTDDLTPFIERKLFTVNTGHAVTAYVGYQRGLKTVKEAIGHPEIRRVVYDALSETGEYLVKAYGFKQAEHEQYMKKSSAALIMNTSRMM

SEQ ID NO: 205 - DNA, 90 bp, Bacillus amyloliquefaciens
atgtacctgtttttttattccataaaaaatctcagaatcgaaataaaatcattgactttatataaaaagaaagtaacatactatttgtaa

SEQ ID NO: 206 - protein, 29 aa, Bacillus amyloliquefaciens
MYLFFYSIKNLRIEIKSLTLYKKKVTYYL

SEQ ID NO: 207 - DNA, 591 bp, Bacillus subtilis
gtgacgagagaaaaaaatccgctgcccatcacgttttatcaaaaaaccgctcttgagcttgccccatcgcttctgggctgccttcttgtaaaagaaacagacgaaggcacagcgtcaggctatattgtggaaacagaggcctatatgggggctggagacagagcggcccacagctttaacaaccgccggacgaagcggactgagatcatgtttgcagaagctgggcgggtatatacatacgtgatgcacacccatacattgctgaatgtcgttgcggcggaagaggatgtcccgcaagcagtattaatcagggcgattgagccgcatgaaggccagctgttaatggaggagagaaggccgggcaggagtccgagggaatggacaaacggaccaggaaagctgacgaaagcgcttggcgtcacgatgaatgactacggacgctggatcacggaacagccgctttacatcgaaagcgggtacacaccggaagcaatttcaaccggcccgcgcatcggcattgacaacagcggggaggcacgcgattatccatggcgtttctgggtgacgggaaacaggtacgtgtcgcgttag

SEQ ID NO: 208 - protein, 196 aa, Bacillus subtilis
MTREKNPLPITFYQKTALELAPSLLGCLLVKETDEGTASGYIVETEAYMGAGDRAAHSFNNRRTKRTEIMFAEAGRVYTYVMHTHTLLNVVAAEEDVPQAVLIRAIEPHEGQLLMEERRPGRSPREWTNGPGKLTKALGVTMNDYGRWITEQPLYIESGYTPEAISTGPRIGIDNSGEARDYPWRFWVTGNRYVSR

SEQ ID NO: 209 - DNA, 1191 bp, Bacillus subtilis
atggcagagagtcttcttatcaaagacattgcgatcgtgacagaaaatgaagtaatcaaaaacggctatgtcggaatcaatgacggaaaaatcagcacagtctcaacagaacggcccaaggagtcatattcaaaagaaattcaagcacctgcgaattccgttttgcttcccggcatgattgacattcatatccacggcggctatggtgcagatacgatggatgcaagcttttctgcgctcgacatcatgtcgtcaagactgcccgaagaaggcacgacgagctttttagccacaacgattacccaagagcatgggaacatttctcaagctttggtgaacgcaagagagtggaaagcggctgaagagtcctctttattaggtgcagaactgctcggcattcatttagagggcccctttgtttcgcttaaaagagccggagcgcagccaaaggagtggattaggccttcggatgttgcgcttttcaaaaagtggcagcaggaggcaggcggactgatcaaaattgttacacttgcgccggaggaggatcagcattttgaactgatccgccatttgaaagacgaatcgattatcgcatccatggggcacacggatgccgattccgcattgctgtcggatgccgcaaaagcaggggcgagccatatgacccatctgtacaacgcgatgagcccgtttcatcaccgagagcccggagtgatcggaacggcgctggcccatgatgggtttgtgacagagcttatcgccgatagcattcactcccaccctttagctgcaaagcttgcttttttggcgaaaggcagcagcaagctcattttaattaccgattccatgagggcaaaaggcctgaaagacggcgtatatgagttcggcggccaaagtgtgacggtaagaggacgaacagctcttctttcagacggaacccttgccggttcgatcctcaaaatgaacgaaggcgcacggcatatgcgtgagtttacaaattgctcttggacggatatagctaatataacttctgcaaacgcggccaaacagctgggcatctttgaccgaaaaggcagtgtgactgtgggaaaagatgcagatttggtgattgtcagcagtgattgcgaggtgattctcaccatttgccgcggaaacattgcatttatatccaaggaggctgaccagatatga

SEQ ID NO: 210 - protein, 396 aa, Bacillus subtilis
MAESLLIKDIAIVTENEVIKNGYVGINDGKISTVSTERPKESYSKEIQAPANSVLLPGMIDIHIHGGYGADTMDASFSALDIMSSRLPEEGTTSFLATTITQEHGNISQALVNAREWKAAEESSLLGAELLGIHLEGPFVSLKRAGAQPKEWIRPSDVALFKKWQQEAGGLIKIVTLAPEEDQHFELIRHLKDESIIASMGHTDADSALLSDAAKAGASHMTHLYNAMSPFHHREPGVIGTALAHDGFVTELIADSIHSHPLAAKLAFLAKGSSKLILITDSMRAKGLKDGVYEFGGQSVTVRGRTALLSDGTLAGSILKMNEGARHMREFTNCSWTDIANITSANAAKQLGIFDRKGSVTVGKDADLVIVSSDCEVILTICRGNIAFISKEADQI

SEQ ID NO: 211 - DNA, 1974 bp, Bacillus subtilis
atgaaaaagctgataaccgcagacgacatcacagcgattgtctctgtgaccgatcctcaatacgccccagacggcacccgtgccgcatatgtaaaatcacaagtgaatcaagagaaagattcgtatacatcaaatatatggatctatgaaacgaaaacgggcgggtctgttccttggacacatggagaaaagcgaagcaccgacccaagatggtctccggacgggtgcacgcttgcctttatttctgatcgagaaggcgatgcggcacagctgtatatgatgagcgctgaaggcggagaagcgagaaaactgactgatatcccgtatggcgtgtcaaagccaatatggtccccggatggcgaatcgattctggtcactgtcagtttgggagagggagaaaacattgatgaccgagaaaaaacagagcaggacagctatgaacctgttgaagtgcaaggcctctcctacaaacgggacggcaaagggctgacgagaggtgcgtatgcccagcttgtgcttgtcagcgtaaagtcgggtgagatggaagagctgacaagtcacaaagctgatcatggtgatcctgctttttctcctgacggcaaatggcttgttttctcagctaatttaactgaaacagatgatgccagcaagccgcatgatgtttacataatgtcactggagtctggagatcttaagcaggttacacctcatcgcggctcattcggatcaagctcattttcaccagacggaaggtatcttgctttgcttggaaatgaaaaggaatataagaatgctacgctctcaaaggcgtggctctatgatatcgaacaaggccgcctcacatgtcttactgagatgctggacgttcatttagcggatgcgctgattggagattcattgatcggtggtgctgaacagcgcccgatttggacaaaggacagccaagggttttatgtcatcggcacagatcaaggcagtacgggcatctattatatttcgattgaaggccttgtgtatccgattcgtctggaaaaagagtacatcaatagcttttctctttcacctgatgaacagcactttattgccagtgtgacaaagccggacagaccgagtgagctttacagtatcccgcttggacaggaagagaaacagctgactggcgcgaatgacaagtttgtcagggagcatacgatatcaatacctgaagagattcaatatgctacagaagacggcgtgatggtgaacggctggctgatgaggcctgcacaaatggaaggtgagacaacatatccacttattcttaacatacacggcggtccgcatatgatgtacggacatacatattttcatgagtttcaggtgctggcggcgaaaggatacgcggtcgtttatatcaatccgagaggaagccacggctacgggcaggaatttgtgaatgcggtcagaggagattatgggggaaaggattatgacgatgtgatgcaggctgtggatgaggctatcaaacgagatccgcatattgatcctaagcggctcggtgtcacgggcggaagctacggaggttttatgaccaactggatcgtcgggcagacgaaccgctttaaagctgccgttacccagcgctcgatatcaaattggatcagctttcacggcgtcagtgatatcggctatttctttacagactggcagcttgagcatgacatgtttgaggacacagaaaagctctgggaccggtctcctttaaaatacgcagcaaacgtggagacaccgcttttgatactgcatggcgagcgggatgaccgatgtccgatcgagcaggcggagcagctgtttatcgctctgaaaaaaatgggcaaggaaaccaagcttgtccgttttccgaatgcatcgcacaatttgtcacgcaccggacacccaagacagcggatcaagcgcctgaattatatcagctcatggtttgaccaatatctctaa

SEQ ID NO: 212 - protein, 657 aa, Bacillus subtilis
MKKLITADDITAIVSVTDPQYAPDGTRAAYVKSQVNQEKDSYTSNIWIYETKTGGSVPWTHGEKRSTDPRWSPDGCTLAFISDREGDAAQLYMMSAEGGEARKLTDIPYGVSKPIWSPDGESILVTVSLGEGENIDDREKTEQDSYEPVEVQGLSYKRDGKGLTRGAYAQLVLVSVKSGEMEELTSHKADHGDPAFSPDGKWLVFSANLTETDDASKPHDVYIMSLESGDLKQVTPHRGSFGSSSFSPDGRYLALLGNEKEYKNATLSKAWLYDIEQGRLTCLTEMLDVHLADALIGDSLIGGAEQRPIWTKDSQGFYVIGTDQGSTGIYYISIEGLVYPIRLEKEYINSFSLSPDEQHFIASVTKPDRPSELYSIPLGQEEKQLTGANDKFVREHTISIPEEIQYATEDGVMVNGWLMRPAQMEGETTYPLILNIHGGPHMMYGHTYFHEFQVLAAKGYAVVYINPRGSHGYGQEFVNAVRGDYGGKDYDDVMQAVDEAIKRDPHIDPKRLGVTGGSYGGFMTNWIVGQTNRFKAAVTQRSISNWISFHGVSDIGYFFTDWQLEHDMFEDTEKLWDRSPLKYAANVETPLLILHGERDDRCPIEQAEQLFIALKKMGKETKLVRFPNASHNLSRTGHPRQRIKRLNYISSWFDQYL

SEQ ID NO: 213 - DNA, 1620 bp, Bacillus subtilis
atgctgaaaggatttacgccttggcctgatgagttagctgagacctatcgaaagaacggctgctgggccggtgagacgtttggagatttgttaagggaccgggcagccaaatatggtgatcgcattgccattacatgcggaaacacccattggagctatcgagagctggacacaagggctgatcgcctggctgccggatttcagaagctcggcattcaacagaaggatcgtgttgtggtgcagctgccaaatatcaaagagttttttgaagttattttcgcgctattccgtctgggggcgcttccagtcttcgcactgccttctcatcgaagcagtgaaattacatatttttgcgagtttgctgaagcggctgcatatatcattcccgacgcatattccggttttgactaccgttcgcttgccagacaggttcaaagcaagctgccgactttgaaaaacatcattgtcgcaggtgaggcagaggaatttttgccgctggaggatttgcatacagaacctgtaaaactgcctgaagtcaaatcttcagatgtggcgttcctccagctttctggcgggagcaccgggctatcgaaactgattccgaggacccacgatgactacatatacagcctgaagcggagtgtggaggtctgctggctcgaccacagcacggtgtacttggccgcgctgccgatggcacacaattatccgctgagctcacctggcgttctcggcgtattatacgctggaggaagagtggtattatctccttctccaagtccagatgacgcatttcctttaattgaacgggaaaaggtcacgataaccgctcttgttccgcctcttgcgatggtatggatggatgcggcatcctcacgccgtgacgatttatccagccttcaagtgttgcaggtcggcggtgccaagtttagtgctgaagccgcgcgcagggtaaaagctgttttcggctgcacgctgcagcaggtgttcggaatggcagagggtctcgtcaattatacgagattggatgatcctgaggagatcattgtcaacacccaaggaaaaccgatgtccccatatgatgaagtgcgtgtttgggatgatcatgatcgcgacgtaaaacctggtgaaacaggccatttgctgacgcggggaccgtatacaattcgaggttactataaggcagaagagcataacgccgcttcatttactgaggacggtttttaccgtacgggtgatatcgtcaggctgacacgagacgggtatattgtcgttgaaggccgggcgaaggatcaaattaaccgtggaggagaaaaggttgcggctgaagaggtggaaaatcatctgctggcgcatccggctgtccatgatgcggcaatggtctccatgcctgatcaatttcttggcgaaagatcttgtgtgttcattattccccgggatgaagccccaaaagccgcagagctcaaagcatttttgagagagcgcggactggcggcatataaaatccctgatcgagttgaatttgtcgaatcctttccgcagacaggggtaggaaaagtcagcaaaaaagcgctccgtgaagccatttccgagaagcttcttgcaggattaaaaaaataa

SEQ ID NO: 214 - protein, 539 aa, Bacillus subtilis
MLKGFTPWPDELAETYRKNGCWAGETFGDLLRDRAAKYGDRIAITCGNTHWSYRELDTRADRLAAGFQKLGIQQKDRVVVQLPNIKEFFEVIFALFRLGALPVFALPSHRSSEITYFCEFAEAAAYIIPDAYSGFDYRSLARQVQSKLPTLKNIIVAGEAEEFLPLEDLHTEPVKLPEVKSSDVAFLQLSGGSTGLSKLIPRTHDDYIYSLKRSVEVCWLDHSTVYLAALPMAHNYPLSSPGVLGVLYAGGRVVLSPSPSPDDAFPLIEREKVTITALVPPLAMVWMDAASSRRDDLSSLQVLQVGGAKFSAEAARRVKAVFGCTLQQVFGMAEGLVNYTRLDDPEEIIVNTQGKPMSPYDEVRVWDDHDRDVKPGETGHLLTRGPYTIRGYYKAEEHNAASFTEDGFYRTGDIVRLTRDGYIVVEGRAKDQINRGGEKVAAEEVENHLLAHPAVHDAAMVSMPDQFLGERSCVFIIPRDEAPKAAELKAFLRERGLAAYKIPDRVEFVESFPQTGVGKVSKKALREAISEKLLAGLKK

SEQ ID NO: 215 - DNA, 1725 bp, Bacillus subtilis
atggggactaatgtacaggtggattcagcatctgccgaatgtacacagacgatgagcggagcattaatgctgattgaatcattaaaaaaagagaaagtagaaatgatcttcggttatccgggcggggctgtgcttccgatttacgataagctatacaattcagggttggtacatatccttccccgtcacgaacaaggagcaattcatgcagcggagggatacgcaagggtctccggaaaaccgggtgtcgtcattgccacgtcagggccgggagcgacaaaccttgttacaggccttgctgatgccatgattgattcattgccgttagtcgtctttacagggcaggtagcaacctctgtaatcgggagcgatgcatttcaggaagcagacattttagggattacgatgccagtaacaaaacacagctaccaggttcgccagccggaagatctgccgcgcatcattaaagaagcgttccatattgcaacaactggaagacccggacctgtattgattgatattccgaaagatgtagcaacaattgaaggagaattcagctacgatcatgagatgaatctcccgggataccagccgacaacagagccgaattatttgcagatccgcaagcttgtggaagccgtgagcagtgcgaaaaaaccggtgatcctggcgggtgcgggcgtactgcacggaaaagcgtcagaagaattaaaaaattatgccgaacagcagcaaatccctgtggcacacacccttttggggctcggaggcttcccggctgaccatccgctttttctagggatggcgggaatgcacggtacttatacagccaatatggcccttcatgaatgtgatctattaatcagtatcggcgcccgttttgatgaccgtgtcacaggaaacctgaaacactttgccagaaacgcaaagatagcccacatcgatattgatccagctgaaatcggaaaaatcatgaaaacacagattcctgtagtcggagacagcaaaattgtcctgcaggagctgatcaaacaagacggcaaacaaagcgattcaagcgaatggaaaaaacagctcgctgaatggaaagaagagtatccgctctggtatgtagataatgaagaagaaggttttaaacctcagaaattgattgaatatattcatcaatttacaaaaggagaggccattgtcgcaacagatgtaggccagcatcaaatgtggtcagcgcaattttatccgttccaaaaagcagataaatgggtcacgtcaggcggacttggaacgatgggattcggtcttccggcggcgatcggcgcacagctggccgaaaaagatgctactgttgtcgcggttgtcggagacggcggattccaaatgacgctccaagaactcgatgttattcgcgaattaaatcttccggtcaaggtagtgattttaaataacgcttgtctcggaatggtcagacagtggcaggaaattttctatgaagaacgttattcagaatctaaattcgcttctcagcctgacttcgtcaaattgtccgaagcatacggcattaaaggcatcagaatttcatcagaagcggaagcaaaggaaaagctggaagaggcattaacatcaagagaacctgttgtcattgatgtgcgggttgccagcgaagaaaaagtattcccgatggtggctccggggaaagggctgcatgaaatggtgggggtgaaaccttga

SEQ ID NO: 216 - protein, 574 aa, Bacillus subtilis
MGTNVQVDSASAECTQTMSGALMLIESLKKEKVEMIFGYPGGAVLPIYDKLYNSGLVHILPRHEQGAIHAAEGYARVSGKPGVVIATSGPGATNLVTGLADAMIDSLPLVVFTGQVATSVIGSDAFQEADILGITMPVTKHSYQVRQPEDLPRIIKEAFHIATTGRPGPVLIDIPKDVATIEGEFSYDHEMNLPGYQPTTEPNYLQIRKLVEAVSSAKKPVILAGAGVLHGKASEELKNYAEQQQIPVAHTLLGLGGFPADHPLFLGMAGMHGTYTANMALHECDLLISIGARFDDRVTGNLKHFARNAKIAHIDIDPAEIGKIMKTQIPVVGDSKIVLQELIKQDGKQSDSSEWKKQLAEWKEEYPLWYVDNEEEGFKPQKLIEYIHQFTKGEAIVATDVGQHQMWSAQFYPFQKADKWVTSGGLGTMGFGLPAAIGAQLAEKDATVVAVVGDGGFQMTLQELDVIRELNLPVKVVILNNACLGMVRQWQEIFYEERYSESKFASQPDFVKLSEAYGIKGIRISSEAEAKEKLEEALTSREPVVIDVRVASEEKVFPMVAPGKGLHEMVGVKP

SEQ ID NO: 217 - DNA, 411 bp, Bacillus subtilis
atgaacagacaagaattaataacagaagctttaaaagcgcgtgatatggcatatgcgccgtattccaaattccaagtaggagccgctcttcttaccaaggatggaaaagtgtacagaggctgcaatattgagaacgcggcatacagcatgtgcaattgcgccgagcgtaccgctttatttaaagctgtttctgaaggggatacagagtttcagatgctggccgttgcggctgacacccctggaccagtatctccgtgcggagcctgccgacaggtgatttctgagctttgcacaaaagacgttattgtcgtactgactaatttacaaggacaaataaaagaaatgactgtggaagaattattgccaggcgcattttcatcggaggatttacatgacgaacgaaagctttaa

SEQ ID NO: 218 - protein, 136 aa, Bacillus subtilis
MNRQELITEALKARDMAYAPYSKFQVGAALLTKDGKVYRGCNIENAAYSMCNCAERTALFKAVSEGDTEFQMLAVAADTPGPVSPCGACRQVISELCTKDVIVVLTNLQGQIKEMTVEELLPGAFSSEDLHDERKL

SEQ ID NO: 219 - DNA, 894 bp, Bacillus subtilis
ttgctgagaataggctcacacgtctctatgagcggaaaacatatgcttctggcagcaagccaggaagcagtctcttatggggcgaatacgtttatgatttatacaggcgcaccgcaaaatacacgccgaaagaaaattgaagacttaaatatagaagcaggccgggcacatatgcaagaaaacggcattgacgagattatcgtacacgcgccttatattattaatattggcaacacgacaaatccgtccacttttgagctgggtgttgattttcttcgttcagaaattgaacggacagcggccatcggagcgaagcaaattgtccttcatcctggcgctcacgtaggggcaggagctgaagccggcatcaaaaaaattattgaaggcttaaatgaagtgattgatccgaatcaaaatgtccagattgcattagaaacaatggctggaaaaggatcagaatgcggcagaagctttgaggagcttgcacagattatcgaaggcgttacacacaatgagcagctgtcagtgtgctttgacacgtgccatacacatgatgccgggtataacattgtcgaagactttgacggagtgctgaatgagttcgataaagtcattggcattgaccgtattaaagtgcttcatatcaatgacagcaaaaatgtcaaaggtgcgagaaaagaccgccatgaaaatattggctttggtgaaataggttttgacgcactgcaatatgttgttcaccatgagcagttaaaagacattccaaaaattcttgaaacaccatatgtcggtgaagataaaaagaacaaaaaaccgccataccgttttgagattgacatgctgaaagaaaaacaatttgatgatacattgctcgaaaagattttacagcaataa

SEQ ID NO: 220 - protein, 297 aa, Bacillus subtilis
MLRIGSHVSMSGKHMLLAASQEAVSYGANTFMIYTGAPQNTRRKKIEDLNIEAGRAHMQENGIDEIIVHAPYIINIGNTTNPSTFELGVDFLRSEIERTAAIGAKQIVLHPGAHVGAGAEAGIKKIIEGLNEVIDPNQNVQIALETMAGKGSECGRSFEELAQIIEGVTHNEQLSVCFDTCHTHDAGYNIVEDFDGVLNEFDKVIGIDRIKVLHINDSKNVKGARKDRHENIGFGEIGFDALQYVVHHEQLKDIPKILETPYVGEDKKNKKPPYRFEIDMLKEKQFDDTLLEKILQQ

SEQ ID NO: 221 - DNA, 828 bp, Bacillus subtilis
ttgttaaaaacatatcaaaaacttttggctatgggtatctttttaatcgtattatgctcgggcaatgctgcatttgcagcgactaatcaggtgggaggcctcagcaacgtaggttttttccacgattatttaatcgaaccgttttccgctctgcttaagggtgttgccgggctgtttcacggagaatacggactctctattatcctcgtaaccattattgtgcgtatggttgtactgcctttgtttgttaatcagttcaaaaaacaacgcgtgttccaagagaaaatggccgttattaaacctcaggttgacagcattcaggccaaattgaaaaaaacgaaggaccctgaaaaacaaaaagagctgcaaatggaaatgatgaagctgtatcaagagaacaacatcaatccgcttgctatgggatgcctcccaatgctgattcagtttcctattgtgattgggttttattacgcgattcgctctacacctgaaattgcgtcacactcgtttttatggttcagtttaggacaatctgacattctcgtgtctcttagcgcgggagcaatgtactttatccaggcctatgtcgctcaaaaactgagcgcgaaatattccgctgtcccgcaaaaccctgcggcacagcaatccgcaaaattgatggtgttcatcttccctgtgatgatgacgattttctcgcttaatgttccggcagcccttccgctgtactggtttacaagcggactgtttttgacagtgcaaaacatcgtccttcagatgacgcatcataaaagtaaaaaaacagccgctcttactgagtcggtgaaataa

SEQ ID NO: 222 - protein, 275 aa, Bacillus subtilis
MLKTYQKLLAMGIFLIVLCSGNAAFAATNQVGGLSNVGFFHDYLIEPFSALLKGVAGLFHGEYGLSIILVTIIVRMVVLPLFVNQFKKQRVFQEKMAVIKPQVDSIQAKLKKTKDPEKQKELQMEMMKLYQENNINPLAMGCLPMLIQFPIVIGFYYAIRSTPEIASHSFLWFSLGQSDILVSLSAGAMYFIQAYVAQKLSAKYSAVPQNPAAQQSAKLMVFIFPVMMTIFSLNVPAALPLYWFTSGLFLTVQNIVLQMTHHKSKKTAALTESVK

SEQ ID NO: 223 - DNA, 2751 bp, Bacillus subtilis
atgtcagatcaatttaacagccgtgaagctcgacgaaaagcgaacagcaaatcgagtccttcaccgaaaaaaggcaagaaacgaaaaaagggcggattgtttaaaaagacccttttcactttactcattctgtttgttttaggcgtagttggcggtgctgttatatttgccgtcatggtttctgatgcgccgtcccttgatgaaagcaaattgaagacgccttattcatcaacgatttatgataaaaatggaaaagagatcgccgaagtcggcgccgaaaaacggacctacgtctcgatagatgaaattcccgatgttgtaaaagaagcctttatcgcgacagaagacgctcgtttttatgagcaccacgggattgaccctgtccgtatcggcggtgcattagttgccaactttaaagacggcttcggggctgaaggcggaagtacgatcacccagcaggtcgtcaaaaactcccttctttcacatcagaagacgttgaaacggaaggtgcaggaagtatggctttcgattcagctggagcgcaattactctaaagatgaaattttagaaatgtatttaaaccggatttatttttctcctagagcatacggaatcggaaaagcggcggaagaatttttcggcgttacagatttaagcaaattgactgtcgaacaggctgcgacgcttgcaggaatgccgcaaagcccaacagcgtacaacccggtcaaaaacccggataaagcggaaaaacgacgcaacatcgtactcagtctgatgaaaaaacaaggatttatttctgattctcaatataacaaagcgaaaaaagtggcagtgaaagacgaaggcgtcgtgtcacagaaggaatatgaaaaagcaagtacaaacaaatacagcgcatttgttgaagaggttatgaaggaaattgatgaaaaatctgatgtcgatccatctgctgacggattaaagatctatacgacattagatacaaaagcacaagataaactagatgaattaatggacggagacaccgtcggatttactgaaggcatgcagggcggcgttacccttctcgatacgaaaaccggagaagtgcgggcgattggcgccggaagagattctacggttggtggctataattacgcgacccaagctaagcgacagcctggatctaccattaaacctattctcgactacggtccagttattgaaaataaaaaatggtcaacttacgagcaaattgatgactcagcttacacgtattcagatggaacacctattcgagactttgaccgttcctataaaggggtcatgtctatgcgtgaagccctcgcccaatcacgtaacattccggctctaaaagcattccaagcagtcggaaaagatgcagcagttgattttgctaatggactggggctcggattaaataaagaaaaagtgtatgaatcatattctatcggaggattcggagaaggtaatcccggtgtctctactctaactatggctggagcatacagtgcattcggaaataacggaacatataacgaaccgcattttgtgaaatcaatagaatttaatgacggcacgaagcttgacttaacacccaaatcaaaatcagcaatgagcgattatacagccttcatgattacagatatgctgaaaacagctgttaaaacaggtactggacagcttgcacaagttccgggagtggaagttgcaggtaaaacaggtacaacaaactttgatgaagcggatatgcaaaaatacaatatcgcacaaggcggtgtaccagattcttggtttgtaggatatacacctcaatataccgctgctgtttggacaggtgtagattctcaaaataagataggaaaaaaatctttaaataaaacagagcaacagattgcaaagcgcatcttcgcccagctcatcgccgatgtcgatgacggaagcggatcatttgagaaacctgacagcgtagtggaagcctctgtagaaaaaggctcaaaccctgcaaaactggcagggccaaatacgccaagcgataagaagctcacagagtactttgttaaaggcacagctccttctactgtttctaaaacatatgagaaagaagaaaaagaggaaacagctaaactgtctggtttaaacgtgaaatacgataaagacaatcaatctttaacgttaagctggaattacgacggagatgcgacctttgctgttaagcaatctgttgatggcggcagctactcagaaattcaaaacagctctgcaaaagaggcagtcatatcgggtgtgcagccaggatctgtgtacaaattcgaagtaacagccgtcagtgatgatggcaaaagtacagcttccacatcctatgaggtgccaaaagctgaagacgatgaagataaaaaagaccagcaacaaacggatgatgaaaaacaagatgatgagaagactcaggatgatacacaaactgatgattctcaaaaagatgacggtcagacggatcaagatcagacagatgattcaacaaacgatcaagacaaaaaacaagacaatacgaacaccaatccgtccgacaacaataaccaagaccaatcaaacgataacgataacgacaacagtaacaaccaggatacgtcggatggtgattcgaactctggtaagaatgattcaacaggttctgacacgaataaaaataaaacagacacatctaataaaacacaaacaaactcatcatccattgaaaaaacaaattaa

SEQ ID NO: 224 - protein, 916 aa, Bacillus subtilis
MSDQFNSREARRKANSKSSPSPKKGKKRKKGGLFKKTLFTLLILFVLGVVGGAVIFAVMVSDAPSLDESKLKTPYSSTIYDKNGKEIAEVGAEKRTYVSIDEIPDVVKEAFIATEDARFYEHHGIDPVRIGGALVANFKDGFGAEGGSTITQQVVKNSLLSHQKTLKRKVQEVWLSIQLERNYSKDEILEMYLNRIYFSPRAYGIGKAAEEFFGVTDLSKLTVEQAATLAGMPQSPTAYNPVKNPDKAEKRRNIVLSLMKKQGFISDSQYNKAKKVAVKDEGVVSQKEYEKASTNKYSAFVEEVMKEIDEKSDVDPSADGLKIYTTLDTKAQDKLDELMDGDTVGFTEGMQGGVTLLDTKTGEVRAIGAGRDSTVGGYNYATQAKRQPGSTIKPILDYGPVIENKKWSTYEQIDDSAYTYSDGTPIRDFDRSYKGVMSMREALAQSRNIPALKAFQAVGKDAAVDFANGLGLGLNKEKVYESYSIGGFGEGNPGVSTLTMAGAYSAFGNNGTYNEPHFVKSIEFNDGTKLDLTPKSKSAMSDYTAFMITDMLKTAVKTGTGQLAQVPGVEVAGKTGTTNFDEADMQKYNIAQGGVPDSWFVGYTPQYTAAVWTGVDSQNKIGKKSLNKTEQQIAKRIFAQLIADVDDGSGSFEKPDSVVEASVEKGSNPAKLAGPNTPSDKKLTEYFVKGTAPSTVSKTYEKEEKEETAKLSGLNVKYDKDNQSLTLSWNYDGDATFAVKQSVDGGSYSEIQNSSAKEAVISGVQPGSVYKFEVTAVSDDGKSTASTSYEVPKAEDDEDKKDQQQTDDEKQDDEKTQDDTQTDDSQKDDGQTDQDQTDDSTNDQDKKQDNTNTNPSDNNNQDQSNDNDNDNSNNQDTSDGDSNSGKNDSTGSDTNKNKTDTSNKTQTNSSSIEKTN

SEQ ID NO: 225 - DNA, 696 bp, Bacillus subtilis
ttgaggggtttttttgtgacgggaactgatacagaagtggggaaaacggttatatccagcggtcttgctgccttattgaaagaacataatagagatgtcggtgtgtataaaccatttttaagcgggatatcgcgtcatcatccagatagtgatacaagtttgctgaaagacatgtcgcagaccagtctttctcatgaagacattacgccttttgccttcaaagcgccgcttgcaccatacgttgcagggaaacttgagggaaagactgtcaccatggaagaggttttaagccattgggggcggattagagaaaaacatgaatgcttcatcgtagaaggtgcaggcggtatttctgtgccattgggagaggactatttggtcagtcatgtcataaaagcgttgcagcttcccatgattattgtggcacgtcctcaccttggaaccattaatcatacctttttaactgtcaaatatgcagaaagcatggggcttccaattgccggaattatcatcaatggaatcagtgactctcctgatgaagatgaaaaaaccaatcctgagatgattgagcgcttatgcggtgtgccgattttaggggttacgccaaagcttgccaacgtgacgaaagaaacggttctacatatggtaaaagaccatatcaatctatcattactgatgaatcaagtgggggtatga

SEQ ID NO: 226 - protein, 231 aa, Bacillus subtilis
MRGFFVTGTDTEVGKTVISSGLAALLKEHNRDVGVYKPFLSGISRHHPDSDTSLLKDMSQTSLSHEDITPFAFKAPLAPYVAGKLEGKTVTMEEVLSHWGRIREKHECFIVEGAGGISVPLGEDYLVSHVIKALQLPMIIVARPHLGTINHTFLTVKYAESMGLPIAGIIINGISDSPDEDEKTNPEMIERLCGVPILGVTPKLANVTKETVLHMVKDHINLSLLMNQVGV

SEQ ID NO: 227 - DNA, 282 bp, Bacillus subtilis
atgcattacataacggcatgtttaaaaatcatcagtgataaagaccttaatgagataatgaaggaattcaaaaaacttgaggaagaaacgaacaaagaagagggttgtattacattccatgcttatccgcttgagccatcagaacgtaaaataatgctttgggagatttgggaaaacgaagaagctgtgaaaacccatttcacgaaaaaacacacaatagacgttcaaaaacaagaattaacggaagtagaatggttaatgaaaagcaatgtgaatgattga

SEQ ID NO: 228 - protein, 93 aa, Bacillus subtilis
MHYITACLKIISDKDLNEIMKEFKKLEEETNKEEGCITFHAYPLEPSERKIMLWEIWENEEAVKTHFTKKHTIDVQKQELTEVEWLMKSNVND

SEQ ID NO: 229 - DNA, 1413 bp, Bacillus subtilis
atgagtgacggcaaaaaacatgtagtcatcatcggcggcggcattaccggtttagccgccgccttctatatggaaaaagaaatcaaagaaaagaatctgccgcttgagctgacacttgttgaggcaagtccgagagtcggcgggaaaatccagactgtcaagaaagacggctatatcatcgaaagagggccagactcatttctggaacgaaagaaaagcgccccgcagcttgttaaagacttaggtcttgagcatttgcttgtcaacaatgcgaccggacaatcctatgtgcttgtaaaccgcaccctgcatccaatgccgaagggcgctgtaatggggataccgacaaaaattgcgccgtttgtttctacgggtctgttttctttgtctgggaaggccagagctgcaatggatttcatcctgcctgcgagcaaaacaaaggatgatcagtcattgggagaattcttccgcagacgtgtcggagatgaagtggtcgagaacttaatcgagccgcttctatcagggatctacgcaggcgacattgacaagctcagcctgatgtcgacatttccgcaattttaccagacggaacaaaagcatagaagcctgattctcggcatgaaaaaaacaaggcctcaaggctcaggccagcagctgacggcaaaaaaacaagggcagttccagactctgtcaaccggtttgcagacccttgtagaagagatcgaaaagcagttaaagctgacgaaggtgtataaaggcacaaaagtgaccaaactcagccatagcggctctggctattcgctcgaactggataacggcgtcacacttgatgctgattcagtaattgtgactgctccgcataaagcggctgcgggaatgctttctgagcttcctgccatttctcatttgaaaaatatgcactccacatccgtggcaaacgtcgctttaggtttccctgaaggctccgtccaaatggagcatgagggcacgggttttgtcatttcaagaaacagtgactttgcgatcacagcctgtacgtggacgaataaaaaatggccgcacgcagcgccggaaggcaaaacgctgcttcgggcatatgtcggaaaagctggagacgaatccattgtcgatctatcagataatgacattatcaacattgtgttagaagacttaaagaaagtcatgaacataaacggcgagccggaaatgacatgtgtcacccgatggcatgaaagcatgccgcagtaccatgtcggccataagcagcgtatcaaggagctgcgtgaagcacttgcatctgcgtatccgggtgtttatatgacaggcgcttctttcgaaggtgtcggcattcccgactgcattgatcaaggaaaagctgccgtgtctgacgcgcttacctatttattcagctaa

SEQ ID NO: 230 - protein, 470 aa, Bacillus subtilis
MSDGKKHVVIIGGGITGLAAAFYMEKEIKEKNLPLELTLVEASPRVGGKIQTVKKDGYIIERGPDSFLERKKSAPQLVKDLGLEHLLVNNATGQSYVLVNRTLHPMPKGAVMGIPTKIAPFVSTGLFSLSGKARAAMDFILPASKTKDDQSLGEFFRRRVGDEVVENLIEPLLSGIYAGDIDKLSLMSTFPQFYQTEQKHRSLILGMKKTRPQGSGQQLTAKKQGQFQTLSTGLQTLVEEIEKQLKLTKVYKGTKVTKLSHSGSGYSLELDNGVTLDADSVIVTAPHKAAAGMLSELPAISHLKNMHSTSVANVALGFPEGSVQMEHEGTGFVISRNSDFAITACTWTNKKWPHAAPEGKTLLRAYVGKAGDESIVDLSDNDIINIVLEDLKKVMNINGEPEMTCVTRWHESMPQYHVGHKQRIKELREALASAYPGVYMTGASFEGVGIPDCIDQGKAAVSDALTYLFS

SEQ ID NO: 231 - DNA, 519 bp, Bacillus subtilis
atgaaaacaaaagagttagtcattatggctctgtttgccgctatcggcgcagcgcttcattccattattccgccctttttaggcggcatgaaaccagatatgatgctgatcatgatgttcatgggcattctgctgttcccgcgggtgcaaaatgtactcgtcatcgggatcgtgaccggaatcatttccgcgcttacaaccgcgtttccagccggacagatccctaacatcattgataaacccgtatcagcgtttctgttcttctccctgtttctcttgttcagaaagagccggaaaacaggtgcagccgctgtgctgacagtgatcgggaccatcttatcaggaattgtgtttctatcgtcagctttattgatcgtcggtttaccgggcggtttcgccgcattgttcgcggctgttgttctgccggccgctgtgctgaatacaatctcaatgatcattatttatccgattgtgcaaaccattttaaggcgttcaagctttatggaagctgctaaataa

SEQ ID NO: 232 - protein, 172 aa, Bacillus subtilis
MKTKELVIMALFAAIGAALHSIIPPFLGGMKPDMMLIMMFMGILLFPRVQNVLVIGIVTGIISALTTAFPAGQIPNIIDKPVSAFLFFSLFLLFRKSRKTGAAAVLTVIGTILSGIVFLSSALLIVGLPGGFAALFAAVVLPAAVLNTISMIIIYPIVQTILRRSSFMEAAK

SEQ ID NO: 233 - DNA, 768 bp, Bacillus subtilis
atggagtttgttcaatatgcatgtaatggggccgttgcagagattatcctgaatcggcctgatgcccatcacgccctgaatgaacagatgctgtctgaattgaaggaggcagtcgaaatggcggctgcaagcgaggcgctcatcgttctcctgagaggaagcgggaaaggcttttcggccggcggtgatatcaggatgatgacgtcagagcatgaccctgaccaatttaaacggctgatggatacgattgaggctgtcaccctgaatttatatcagatgaagaaagtgacaattgcagccattcatggtgctgctgcgggactgggcctgagtttggcgctttgtacggacattgtgctcgctgaaaaaaacgccgttctcgcgatgaattttatcggcattgggcttgttccggacggcggaggacattatttgctgaagaaaagaatcggtgaagcaaaagcgaaaaaactgatttggagcggaaaaaaactatctgcctcggaagctgccgatatggggcttcttgatgggacatttgccggagaccctgccgaaggcgcaagacccattatcgaaaccctgttggcctcccctcttttggcgatgatcgaaacgaaaggtatttttcaaagcctccaaattgaagaactgaaaaaagtgctatcccttgagcgcagcgcccaagagagaatgagaaggaccaaggatcaccaagaaggaatccgtgcctttttagaaaaacgggagccgaagtttcaagcgtaa

SEQ ID NO: 234 - protein, 255 aa, Bacillus subtilis
MEFVQYACNGAVAEIILNRPDAHHALNEQMLSELKEAVEMAAASEALIVLLRGSGKGFSAGGDIRMMTSEHDPDQFKRLMDTIEAVTLNLYQMKKVTIAAIHGAAAGLGLSLALCTDIVLAEKNAVLAMNFIGIGLVPDGGGHYLLKKRIGEAKAKKLIWSGKKLSASEAADMGLLDGTFAGDPAEGARPIIETLLASPLLAMIETKGIFQSLQIEELKKVLSLERSAQERMRRTKDHQEGIRAFLEKREPKFQA

SEQ ID NO: 235 - DNA, 1098 bp, Bacillus subtilis
atgggtattgcaggaacctttatttttatgatcgtgatcggcgctgccattggagcggtgaccaatcatttagcaattcaaatgctgtttaggccgtataaagcgtactatttgtttgggaaacgagttccttttacgcccgggctgattccaagacggcgagatgaacttgcaaaacaaatgggactgatggtagtcaatcatctcttaacccctgaaggcattaaaaagcggctcgtctctgatgcagccaaaacgcaggctcttcgagtgggggaacagctgattcaaaagctgtcactttctgaagtgacagtaaaagaagcgcttgaaaaagccgggatgaagcgcccagaaaaagctgctgatgcatggatcagcagctggaccgatgataagctgaatgagcttttccgccaatacggggaccaatcgttaaaagagctggtgcctatagaggtgcaggaaaagcttgaggaaaaaattccgatgatttcaggatatatattgtcacggagtgtcagttattttgaaagtgatgaaggaaaaatccgtcttggcaatatgattgatgactttttaaaagagcgcggcatgcttggaagcatggtgcaaatgtttcttggcaattcaagccttgcggatcgcgtgctgccggagctgctgaaattcttgcgcaatgaggaaacaaataaattgctttctgatctcttaaaaaacgaatggggcaagctgagggagtatacgtttaatgaagcagatgaaaaatggaatgcaaaggcgctcattttcagtttgaaacgaagagtgctgcaagcattttcgactgcccctttcttcgacaatacgattggcacgcttaccgtccgctatgaatctgagctgacccagcaaatgctgccggcactgttagacaaattgcttgaagggatttcgtccaaccttgaaagtgtcttaaaacggttgcgtcttgaggaaatcgtcaaggagcaggtggatcagttcccggtggagcgtcttgaagaaatggtgctgtccatttcaaaaaaagaatttaaaatgattacctatttgggggccttctcggcggaattatag

SEQ ID NO: 236 - protein, 365 aa, Bacillus subtilis
MGIAGTFIFMIVIGAAIGAVTNHLAIQMLFRPYKAYYLFGKRVPFTPGLIPRRRDELAKQMGLMVVNHLLTPEGIKKRLVSDAAKTQALRVGEQLIQKLSLSEVTVKEALEKAGMKRPEKAADAWISSWTDDKLNELFRQYGDQSLKELVPIEVQEKLEEKIPMISGYILSRSVSYFESDEGKIRLGNMIDDFLKERGMLGSMVQMFLGNSSLADRVLPELLKFLRNEETNKLLSDLLKNEWGKLREYTFNEADEKWNAKALIFSLKRRVLQAFSTAPFFDNTIGTLTVRYESELTQQMLPALLDKLLEGISSNLESVLKRLRLEEIVKEQVDQFPVERLEEMVLSISKKEFKMITYLGAFSAEL

SEQ ID NO: 237 - DNA, 537 bp, Bacillus subtilis
atgacatcagtcaatctaagctacccaataggagaatacaaggcgagggaatccgtatcgaaggagcaaaaagataaatggattcaagtacttgaagaagtgccggcaaaattgaagcaagctgtagagggcatgacggacagccagcttgacacaccgtaccgggacggtggatggaccgttcggcaagttgttcatcatctggctgacagtcatatgaacagctatattcgttttaaattgagcttgacggaagagacaccggctattcgtccgtatgatgaaaaagcatggtcggagctaaaagactcgaaaacggcagatccgagcggctcactcgcgcttttgcaggagcttcacggaagatggacggctctgctccgcactctgacggatcagcaatttaagcgcggattttatcaccctgatacaaaggagatcattaccctggagaacgcgctcggcctgtatgtctggcactcacatcatcatatcgctcatattacggagctttccagacggatggggtggtcttaa

SEQ ID NO: 238 - protein, 178 aa, Bacillus subtilis
MTSVNLSYPIGEYKARESVSKEQKDKWIQVLEEVPAKLKQAVEGMTDSQLDTPYRDGGWTVRQVVHHLADSHMNSYIRFKLSLTEETPAIRPYDEKAWSELKDSKTADPSGSLALLQELHGRWTALLRTLTDQQFKRGFYHPDTKEIITLENALGLYVWHSHHHIAHITELSRRMGWS

SEQ ID NO: 239 - DNA, 447 bp, Bacillus subtilis
atgacatgggcgatcgtgatgttaattctcatgagtctggtgaaaatcgtattaacctgtcttcctacaggcgtcatagaatggctgctcggcaaatttgaagtgcacgccaagctgagtgacgaaaatgcgagtctctctctagatggaaaacgcctcgagggtgcagagaagcagaaagtgattgatcaatttaacgaagctatcttcctggaaaaatattatatctatccaggtgatgaagagcgttatttacatccggaaaacggcggcacgcctctggtgatagatacaaaaaaaggaaaaaaagacgtgaagctgttcgtgtaccgctacgacgaccatatcgacgtcgtgaaacagtacaagaagaaagtgatcgcgtatcgagtgctttctgaaagccttcaaaaagagtctctgtcagtggcgggaagtttagcttaa

SEQ ID NO: 240 - protein, 148 aa, Bacillus subtilis
MTWAIVMLILMSLVKIVLTCLPTGVIEWLLGKFEVHAKLSDENASLSLDGKRLEGAEKQKVIDQFNEAIFLEKYYIYPGDEERYLHPENGGTPLVIDTKKGKKDVKLFVYRYDDHIDVVKQYKKKVIAYRVLSESLQKESLSVAGSLA

SEQ ID NO: 241 - DNA, 543 bp, Bacillus subtilis
atgtcagcttttaagattgagaacgaaacgattgcagatggattttacgcgtgtccggccgtctatgaggatgcagaatcgattaccgggttgctcgtccgaacagctgaatggctccgggatcggggttctaaccaatggagcggacttctcaaagggcaagatatacatgatatcacggggtcaattgaaaagggacatgtgtttgtgtttaaaaaagatgaagagcttgcggctgtcgtgatgctgctgcctgcaccgagcgagtgggaccggaagctttggggagacgatgggcatgaggagtccatttatttgcatcgcctcgcagtaagccgccggtttgcgggacaggggcttggagcccgcgtccttcagtgggcggagacgggcatacactttccgggaaaaacacggatccggcttgactgtgtcgctgataacgacgccctgcattccttttatcggcgtatgggatatgaattcatgggtgctgatgcgtccggatatcatttgtttgagaaagagattacggcagaataa

SEQ ID NO: 242 - protein, 180 aa, Bacillus subtilis
MSAFKIENETIADGFYACPAVYEDAESITGLLVRTAEWLRDRGSNQWSGLLKGQDIHDITGSIEKGHVFVFKKDEELAAVVMLLPAPSEWDRKLWGDDGHEESIYLHRLAVSRRFAGQGLGARVLQWAETGIHFPGKTRIRLDCVADNDALHSFYRRMGYEFMGADASGYHLFEKEITAE

SEQ ID NO: 243 - DNA, 849 bp, Bacillus subtilis
atgaatgaaaaaaaagagagaatcataaaaaccagcattcgtttatttgcgaaaaaaggattcgcagctacgacgatccaagaaatcgccagtgaatgcggcatttcgaagggcgctttttatttgcacttcaaatcgaaagaagcgctgctgttatctgcctgtgaatattatatcggtatgtctatgaacaaaatgaaaaatatagaagaagatctcgccggaaagccccctaaggaagtgttaaaaaagcaaattggcgctcaatttgaggattttcgcgatcataaagattttatcgttcttttgcttaccgaaaatatcattccggaaaatcaagaaatcaagcaatacttttacaaagtaaccatggagacggataagctgtaccggaacgccttgctggtatcctatggcgaaggaatcgagcggtatgtcgcagatctgtccatcatggcaagaggcattgtgcattcctatatgaacgtgatggtatttaacggtgagcttaatatcgatgcagaagaaatctcagcctttattattgagagactgaatgatcttgtacaggggctgagccgttctgcactcaatccgattgtatcaaaagacattttcaacccgatgcctgcgggaaaagaccagctgcttgaggacattcagaaagtgaaagaaaacagcacgctgcccgaggatatcaccgtgtcacttgatgttatcgaggaagaattgactcaggataaaccgcgcaagccgattattaaaggcatgctgtccaatttgaccggaaccaacgacaaagaagttgaaaggcttcgggccctcatctctgtctttatctcaatttga

SEQ ID NO: 244 - protein, 282 aa, Bacillus subtilis
MNEKKERIIKTSIRLFAKKGFAATTIQEIASECGISKGAFYLHFKSKEALLLSACEYYIGMSMNKMKNIEEDLAGKPPKEVLKKQIGAQFEDFRDHKDFIVLLLTENIIPENQEIKQYFYKVTMETDKLYRNALLVSYGEGIERYVADLSIMARGIVHSYMNVMVFNGELNIDAEEISAFIIERLNDLVQGLSRSALNPIVSKDIFNPMPAGKDQLLEDIQKVKENSTLPEDITVSLDVIEEELTQDKPRKPIIKGMLSNLTGTNDKEVERLRALISVFISI

SEQ ID NO: 245 - DNA, 1563 bp, Bacillus subtilis
atgtctaaacaaggaaattttcaaaaatcaatgtcgctgtttgatctgattttgattgggatgggagccatctttggatcagcgtggctgttcgctgtcagtaatgtcgcttcaaaagcagggccctccggcgctttttcctggatcctcggaggagccattattttgttaatcgggctcgtatatgcggagctcggagccgctctgccccgtaccggaggcatcattcgataccccgtttattcacatggccaccttgtcggctacttaatttcgtttgtcacgattgtcgcttatacaagcttgatttcaattgaagtgacagctgtgcgccagtatgtggcctattggtttcccggcctgaccattaaagggtctgattcgccgaccatttccggctggatcttgcagtttgccctattatgcttgtttttcctgctgaattattggagcgtcaaaaccttcgctaaggcgaatttcatcatatcgatttttaaatatattgtgccgattaccatcattattgtgctgatctttcattttcagccggagaatttatccgttcaaggatttgcaccgtttggatttacaggtattcaggctgcaatctcgacaggcggcgtcatgtttgcgtatctcggcctgcacccgattgtatctgtagcaggtgaagtccaaaatccaaaacgcaatatcccgatcgctttaatcatttgcatcatcgtttcaaccatcatttatactgttttgcaggtcacctttattggtgcaatcccgacagaaacactgaaacatggctggcccgcaattggccgggagttctcattgccgtttaaggatattgcggtcatgctcggattaggctggcttgcaacgcttgtcattttagacgccattctgtctcccggaggaaacgggaatatctttatgaatacgacatcccgccttgtttacgcctgggcgcgtaacggcacattatttggcatattctcaaaggtcaataaagatacggggacaccccgcgcatcgctttggctttcgtttgccctgtccattttctggacacttccctttccttcgtggaatgcgctcgtcaatgtctgttcagtcgcgctcattctttcatatgcgattgcacccatttcttcagctgcgctgagggtcaacgcgaaggacttaaacaggccgttttatttaaagggaatgagcattatcgggccgctttcctttatatttacagcgtttatcgtgtactggtcaggatggaaaacagtctcctggctgctcggttcacaactcgtgatgtttttgatctatctctgtttcagcaaatatacgcctaaagaagatgtcagcctcgctcagcagctgaaatcagcctggtggcttatcgggttttatattatgatgctgatcttttcctacatcggttctttcggacatggtttagggattatcagcaatcccgtcgacctcattttagtcgcgatcggctcacttgcgatttattactgggcaaagtataccgggctcccaaaagccgccattgattacgataaataa

SEQ ID NO: 246 - protein, 520 aa, Bacillus subtilis
MSKQGNFQKSMSLFDLILIGMGAIFGSAWLFAVSNVASKAGPSGAFSWILGGAIILLIGLVYAELGAALPRTGGIIRYPVYSHGHLVGYLISFVTIVAYTSLISIEVTAVRQYVAYWFPGLTIKGSDSPTISGWILQFALLCLFFLLNYWSVKTFAKANFIISIFKYIVPITIIIVLIFHFQPENLSVQGFAPFGFTGIQAAISTGGVMFAYLGLHPIVSVAGEVQNPKRNIPIALIICIIVSTIIYTVLQVTFIGAIPTETLKHGWPAIGREFSLPFKDIAVMLGLGWLATLVILDAILSPGGNGNIFMNTTSRLVYAWARNGTLFGIFSKVNKDTGTPRASLWLSFALSIFWTLPFPSWNALVNVCSVALILSYAIAPISSAALRVNAKDLNRPFYLKGMSIIGPLSFIFTAFIVYWSGWKTVSWLLGSQLVMFLIYLCFSKYTPKEDVSLAQQLKSAWWLIGFYIMMLIFSYIGSFGHGLGIISNPVDLILVAIGSLAIYYWAKYTGLPKAAIDYDK

SEQ ID NO: 247 - DNA, 1644 bp, Bacillus subtilis
atgaaagagatcgtaacattaacaaacgttagctatgaagtgaaggatctgactgtttttaaaaatataaatgccagtgttcagcaaggagatatcattgggattatcggcaaaaacggcgctgggaaatctacgctgctgcacctcattcacaatgacttagccccttcccagggtcaaatccttcgaaaggatataaaactggctttggttgaacaggaaacagcggcatattcctttgcggatcagacacctgccgaaaagaagttactggagaaatggcatgtgcctcttcgtgattttcatcagttaagcggcggtgaaaaactaaaagcgcggctggcgaaaggactatcagaggatgcagatctgctgctgttagatgaaccgacaaaccaccttgatgaaaaaagcttgcaatttctcatccaacagctgaaacattataacggcactgtgattctcgtttctcacgatcgatattttttagacgaagccgcaacaaaaatatggtcgcttgaggatcagacgctgattgaattcaaagggaattactccgggtatatgaagttccgggagaagaaaagactcacccagcagcgtgaatatgaaaagcagcaaaaaatggttgaacggattgaagcacaaatgaatgagctcgcttcttggtcggaaaaagcccatgctcaatcgacgaaaaaggaagggtttaaagaatatcaccgggtaaaagcgaagcgtacggatgcccagataaaatccaagcagaagcggcttgaaaaagagcttgaaaaagcaaaggcggaacccgttaccccagaatatacagtccgcttttcaatcgatacaacccacaaaacagggaaacggtttttagaagttcagaatgtaacaaaagcgtttggagaaaggactctctttaaaaacgcaaactttacaattcagcacggcgaaaaggttgcgatcataggccccaatggcagcggaaaaacgacattgctgaatatcattcttggacaggaaacagcagaaggaagcgtatgggtgtcgccgtccgcaaacatcggctatttaacgcaggaggtgtttgatttgcctttagaacaaacaccggaagagttatttgagaatgaaacattcaaagcaagggggcacgttcaaaatctgatgaggcacttaggttttacagccgaccaatggactgaaccgatcaagcatatgagtatgggtgagcgtgtaaagatcaagctgatggcatatattctggaggaaaaagacgtgctgattttagatgagccgacaaaccatctcgacctgccgtcacgcgaacagctggaagaaacactgtcacaatacagcggcacattgctggcggtttcacatgaccgatactttctcgaaaaaacaacaaacagtaaactcgtcatctcaaacaacggcatcgaaaagcagttaaacgacgctccttcagaaagaaatgagcgggaggagcttcggttaaagcttgagacagaaagacaagaagtgctgggaaagctcagttttatgacgccaaatgataaagggtataaggagcttgatcaggctttcaatgagcttacgaaacgaataaaagagctggatcatcaagacaaaaaagactga

SEQ ID NO: 248 - protein, 547 aa, Bacillus subtilis
MKEIVTLTNVSYEVKDLTVFKNINASVQQGDIIGIIGKNGAGKSTLLHLIHNDLAPSQGQILRKDIKLALVEQETAAYSFADQTPAEKKLLEKWHVPLRDFHQLSGGEKLKARLAKGLSEDADLLLLDEPTNHLDEKSLQFLIQQLKHYNGTVILVSHDRYFLDEAATKIWSLEDQTLIEFKGNYSGYMKFREKKRLTQQREYEKQQKMVERIEAQMNELASWSEKAHAQSTKKEGFKEYHRVKAKRTDAQIKSKQKRLEKELEKAKAEPVTPEYTVRFSIDTTHKTGKRFLEVQNVTKAFGERTLFKNANFTIQHGEKVAIIGPNGSGKTTLLNIILGQETAEGSVWVSPSANIGYLTQEVFDLPLEQTPEELFENETFKARGHVQNLMRHLGFTADQWTEPIKHMSMGERVKIKLMAYILEEKDVLILDEPTNHLDLPSREQLEETLSQYSGTLLAVSHDRYFLEKTTNSKLVISNNGIEKQLNDAPSERNEREELRLKLETERQEVLGKLSFMTPNDKGYKELDQAFNELTKRIKELDHQDKKD

SEQ ID NO: 249 - DNA, 246 bp, Bacillus subtilis
ttgtttcggatttttaaaatgtcttttgcggttatcattattatactggcgcttattgcttttaactatacggaacacacctctgttatccaatcggtcatgctcgtctttcttggtgcggtcatgtttatgcaggggcttgaagaacgcaaaaaagaaaatgacggctcaggcgcttttaatatttataccgccgtttttgtatggtctgtctcccttatcggttttacacttcatattatataa

SEQ ID NO: 250 - protein, 81 aa, Bacillus subtilis
MFRIFKMSFAVIIIILALIAFNYTEHTSVIQSVMLVFLGAVMFMQGLEERKKENDGSGAFNIYTAVFVWSVSLIGFTLHII

SEQ ID NO: 251 - DNA, 1122 bp, Bacillus subtilis
atgatcgccttacatttcggtgcggggaatattgggagagggtttatcggcgcgctgcttcaccactccggctatgatgtggtgtttgcggatgtaaacgacacgatggtcagcctcctcaacgaaaaaaaagaatacacagtagaactggcagaagagggacattcatcagaggtcattggcccggtcagcgcgattaacagcggcagtcagcccgaagagctgtaccggctgatgaatgaggcggcgctcatcacaacagctgtcggcccgaatgtgctgaagctgattgctccatctatcgcagaaggtttaagacggagaaacactgcaaacacactgaatatcattgcctgcgaaaatatgattggcggcagcagcttcttaaagaaagagatatacagccatttaacggaagcagagcagaaatccgtcagtgaaacggtaggttttccgaattctgccgttgaccggatcgtcccgattcagcatcatgaagacccgctgaaagtatcggttgaaccatttttcgaatgggtcattgatgaatcaggctttaaagggaaaacaccagtcataaacggcgcactgtttgttgatgatttaacgccgtacatcgaacggaagctgtttacggtcaataccggacacgcggtcacagcgtatgtcggctatcagcgcggactcaaaacggtcaaagaagcaattgatcatccggaaatccgccgtgttgttcattcggcgctgcttgaaactggtgactatctcgtcaaatcgtatggctttaagcaaactgaacacgaacaatatatcaaaaaaatcatcggccgctttgaaaatcctttcatttcggacgatgtgacccgcgtagcgaggtcacctctcagaaaactgggagaaaatgataggcttgtaggcccggcaaagaaaataaaagagccgaatgcactggcggaaggaattgccgcagccctgcgcttcgatttcaccggtgaccctgaagcggttgaactgcaagcgctgattgaagaaaaaggatacagcggcgtacttcaagaggtgtgcggtattcagtcccatgaaccgttgcacgccatcattttaaagaaacttaatcaataa

SEQ ID NO: 252 - protein, 373 aa, Bacillus subtilis
MIALHFGAGNIGRGFIGALLHHSGYDVVFADVNDTMVSLLNEKKEYTVELAEEGHSSEVIGPVSAINSGSQPEELYRLMNEAALITTAVGPNVLKLIAPSIAEGLRRRNTANTLNIIACENMIGGSSFLKKEIYSHLTEAEQKSVSETVGFPNSAVDRIVPIQHHEDPLKVSVEPFFEWVIDESGFKGKTPVINGALFVDDLTPYIERKLFTVNTGHAVTAYVGYQRGLKTVKEAIDHPEIRRVVHSALLETGDYLVKSYGFKQTEHEQYIKKIIGRFENPFISDDVTRVARSPLRKLGENDRLVGPAKKIKEPNALAEGIAAALRFDFTGDPEAVELQALIEEKGYSGVLQEVCGIQSHEPLHAIILKKLNQ

SEQ ID NO: 253 - DNA, 1353 bp, Bacillus subtilis
atgttctgggtcaaaagcaatttgcaggttttctcccgattccccaaaataaaaagcgaggatgtgatcaacataaaactggaacggtttattgaaaaagacggatatatactggccctcatgctaattacggtgccgctggccggtgaactgaaattttatcccctcaatgaagaattccgggtcagctttggggcaccggtttttttcttctttttatcgttgttgcggcatgtgcccgctgtgctgccgggttttctgactggagcggctgttttcatctttcgcgtctttctggaattatggggcggaggacacaatgggctgactccgattctgtatgatcaagcgtctggctttttcttttatatgacttacgcctgtctgttttccatattaaaggccaatcgtttccgtgaacggccgattatgctcggtttcattgggtttatgattgaagttgtgtcagattgtgtcgagctggctgtgcaatttctcatttttcatacggttgttacgcctgagaaaatcactgacattgcggtgattgcgatttctcacacatttattgtgatgagcttttatagtgtgctgaagctgtatgaaacacaatcgagagaaaaacagacaaggcagcagcacgagcacatgctgatgatcgtttccaatttatatgaagaaacggtgcacctaaaaaagacattgaaaacgacagagaaagtgacaaacgattcgtatcagctctatcgggaaatgaagggcaaggatgttcagctgagcggcagaatcctgagactggccggagagattcatgaagtgaaaaaggacaaccagcggatattcgcagggctttcaaaactgatttcgaatgagagtttgagagattatatgagggcttctgatttgctgcagctcgtgattcgaatgaatgaaaagtacgctgaagcactagggaagcagattgatttttactgctcgatcgagggagagcatgacgaatatcacgtatttatcgtgctttcgatcattaataatctaacagcaaatgcggtagaggctatggatgaagagggaatggtcagcctgaggctccgtaagccaaatgagagtatggtagaattccaggtggaagacaatggccccgggatttccgagaaaatcggagacattgtgtttgacccgggctttacttcaaaatatgacgaatttggcacgccttctacgggtatcggactttcctacgtaaaggaaatcgtgactgagctagaaggggatatcacgtttgataatcagcagcggggagtggtgtttgccatcaggctgcctgtccggcatttgattcagaaagggtga

SEQ ID NO: 254 - protein, 450 aa, Bacillus subtilis
MFWVKSNLQVFSRFPKIKSEDVINIKLERFIEKDGYILALMLITVPLAGELKFYPLNEEFRVSFGAPVFFFFLSLLRHVPAVLPGFLTGAAVFIFRVFLELWGGGHNGLTPILYDQASGFFFYMTYACLFSILKANRFRERPIMLGFIGFMIEVVSDCVELAVQFLIFHTVVTPEKITDIAVIAISHTFIVMSFYSVLKLYETQSREKQTRQQHEHMLMIVSNLYEETVHLKKTLKTTEKVTNDSYQLYREMKGKDVQLSGRILRLAGEIHEVKKDNQRIFAGLSKLISNESLRDYMRASDLLQLVIRMNEKYAEALGKQIDFYCSIEGEHDEYHVFIVLSIINNLTANAVEAMDEEGMVSLRLRKPNESMVEFQVEDNGPGISEKIGDIVFDPGFTSKYDEFGTPSTGIGLSYVKEIVTELEGDITFDNQQRGVVFAIRLPVRHLIQKG

SEQ ID NO: 255 - DNA, 1017 bp, Bacillus subtilis
atgatgaacgacgctttgacgagtttggcatgtagcctcaagccgggtacgacaatcaaaggcaagtggaatggaaacacttatacattgcgtaaacagcttggtaaaggggccaatggaattgtgtatttggcagaagcatcagatggacatgttgccttaaaggtgagtgatgacagcctgtctattacttctgaagtgaatgtcttgaaatctttctcaaaggcccagtccgttacgatggggccttctttttttgatacggatgatgcctatattcccagtaccaatacgaaagtttcattttatgcaatggaatacataaaagggccgctgcttttgaagtatgtcagtgataaaggagcagagtggatacctgtattaatgattcagctgttatccagcttatcggtgcttcaccagcaaggatggatattcggcgatcttaaacctgataatctgatcgtaactggtccgcccgcaaggatccgctgcattgatgtgggcggcacgacaaaggaaggccgggcgataaaagagtatacggagttttatgacagaggctattgggggtatggaacaagaaaggcagagccatcctatgatctgttcgcagttgccatgattatgatcaacagtgtgcataaaaaagaatttaagaaaacgaaccagcccaaagaacagcttaggtctctcatcgaaggaaaccctctgcttcaaaagtataaaaaagtgcttttttcaaccttgaacggagattatcaatccgcagatgaaatgaaaaaggatatgctagacgcggggcaaaaagcagcacaaagaaaacagcctataaaagcatcaccgcagcctgccacacgacatagacagcaaaaaccgcgccaaggaaaaataacgaagacgcgatataccccaaaacagaaaccggctaagtcgggggggttatttgaaacaacgctgatcgtgatcagtgttttagcgctttatttcgcctatattatctttttcttaatctga

SEQ ID NO: 256 - protein, 338 aa, Bacillus subtilis
MMNDALTSLACSLKPGTTIKGKWNGNTYTLRKQLGKGANGIVYLAEASDGHVALKVSDDSLSITSEVNVLKSFSKAQSVTMGPSFFDTDDAYIPSTNTKVSFYAMEYIKGPLLLKYVSDKGAEWIPVLMIQLLSSLSVLHQQGWIFGDLKPDNLIVTGPPARIRCIDVGGTTKEGRAIKEYTEFYDRGYWGYGTRKAEPSYDLFAVAMIMINSVHKKEFKKTNQPKEQLRSLIEGNPLLQKYKKVLFSTLNGDYQSADEMKKDMLDAGQKAAQRKQPIKASPQPATRHRQQKPRQGKITKTRYTPKQKPAKSGGLFETTLIVISVLALYFAYIIFFLI

SEQ ID NO: 257 - DNA, 618 bp, Bacillus subtilis
atgagaagcccctatctgatcggcgtgtttctcgctgccggcaaaagcagaagaatgggtcaaaacaagctggctttgccgctaaaaggagaaaacatcggctcactttccttgaaaactgctctgtcgtcccgccttgatcacgtgctggtcgtcgagcggacagaacatgcctcccttgagtggataggagcgccgtatcacgctccgccttttcaaaaacgctggagcctgcacgtttgccaagacgcagaaaagggtcaggggcattcagtcagcagcggggtgagaaaagcagaaagcatgggggcggacggcgttgtcattttgttagccgaccagcctcagctttccgtcgatcatctcaatgcccttgtggcactggcccctgagccatttgccgtgtcatcgtttttaggggcgttcaccccgccaatctacttctcgtcggcttgttttccttatgtaaaggggttaacgggagatgaaggggctcgcaggctcctgaaaagcggacagcttggagcaggagcggttttggaggcaaaggatagcggcgagttggacgatattgatacacccgaggaatatgacatggtaaggagggcgatggcttga

SEQ ID NO: 258 - protein, 205 aa, Bacillus subtilis
MRSPYLIGVFLAAGKSRRMGQNKLALPLKGENIGSLSLKTALSSRLDHVLVVERTEHASLEWIGAPYHAPPFQKRWSLHVCQDAEKGQGHSVSSGVRKAESMGADGVVILLADQPQLSVDHLNALVALAPEPFAVSSFLGAFTPPIYFSSACFPYVKGLTGDEGARRLLKSGQLGAGAVLEAKDSGELDDIDTPEEYDMVRRAMA

SEQ ID NO: 259 - DNA, 1454 bp, Bacillus amyloliquefaciens
tcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtctgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaacct

SEQ ID NO: 260 - DNA, 1545 bp, Bacillus amyloliquefaciens
ggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtctgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctccttt
